US009637748B2

(12) United States Patent
Johnson et al.

(10) Patent No.: US 9,637,748 B2
(45) Date of Patent: May 2, 2017

(54) CONJUGATIVE PLASMIDS AND METHODS OF USE THEREOF

(71) Applicant: Wisconsin Alumni Research Foundation, Madison, WI (US)

(72) Inventors: Eric A. Johnson, Madison, WI (US); Kristin M. Marshall, Madison, WI (US); Marite Bradshaw, Madison, WI (US)

(73) Assignee: Wisconsin Alumni Research Foundation, Madison, WI (US)

( * ) Notice: Subject to any disclaimer, the term of this patent is extended or adjusted under 35 U.S.C. 154(b) by 0 days.

(21) Appl. No.: 14/096,584

(22) Filed: Dec. 4, 2013

(65) Prior Publication Data

US 2014/0106458 A1     Apr. 17, 2014

Related U.S. Application Data

(63) Continuation of application No. 12/905,592, filed on Oct. 15, 2010, now abandoned.

(60) Provisional application No. 61/252,029, filed on Oct. 15, 2009.

(51) Int. Cl.
C12N 15/74     (2006.01)

(52) U.S. Cl.
CPC ................................ *C12N 15/74* (2013.01)

(58) Field of Classification Search
None
See application file for complete search history.

(56) References Cited

U.S. PATENT DOCUMENTS 5,955,368 A     9/1999 Johnson et al.

FOREIGN PATENT DOCUMENTS

WO     WO2009006281 A1     1/2009

OTHER PUBLICATIONS

Arndt, et al., A Structural Perspective of the Sequence Variability Within Botulinum Neurotoxin Subtypes A1-A4, J. Mol. Biol., 2006, 362(4):733-742.
Aureli, et al., Two Cases of Type E Infant Botulism Caused by Neurotoxigenic Clostridium Butyricum in Italy, Journal of Infectious Diseases, 1986, 154(2)207-211.
Bannam, et al., Functional Identification of Conjugation and Replication Regions of the Tetracycline Resistance Plasmid pCW3 from Clostridium Perfringens, Journal of Bacteriology, 2006, 188(13):4942-4951.
Beverley, Characterization of the 'Unusual' Mobility of Large Circular DNAs in Pulsed Field-Gradient Electrophoresis, Nucleic Acids Research, 1988, 16(3):925-939.
Blaiotta, et al., Conditions for Conjugative Transposon Transfer in Lactococcus Lactis, Letters in Applied Microbiology, 2000, 31:343-348.
Bradshaw, et al., Regulation of Neurotoxin Complex Expression in Clostridium Botulinum Strains 62A, Hall A-hyper, and NCTC 2916, Anaerobe, 2004, 10:321-333.
Brynestad, et al., Enterotoxin Plasmid from Clostridium Perfringens is Conjugative, Infection and Immunity, 2001, 69(5):3483-3487.
Carter, et al., Independent Evolution of Neurotoxin and Flagellar Genetic Loci in Proteolytic Clostridium Botulinum, BMC Genomics, 2009, 10:115, pp. 1-18.
Darling, et al., Mauve: Multiple Alignment of Conserved Genomic Sequence With Rearrangements, Genome Research, 2004, 14:1394-1403.
Dineen, et al., Cloning, Nucleotide Sequence, and Expression of the Gene Encoding the Bacteriocin Boticin B From Clostridium Botulinum Strain 213B, Applied and Environmental Microbiology, 2000, 66(12):5480-5483.
Dover, et al., Letters to the Editor—Novel Clostridium Botulinum Toxin Gene Arrangement with Subtype A5 and Partial Subtype B3 Botulinum Neurotoxin Genes, Journal of Clinical Microbiology, 2009, 47(7)2349-2350.
East, et al., Organization and Phylogenetic Interrelationships of Genes Encoding Components of the Botulinum Toxin Complex in Proteolytic Clostridium Botulinum Types A, B and F: Evidence of Chimeric Sequences in the Gene Encoding the Nontoxic Nonhemagglutinin Component, International Journal of Systematic Bacteriology, 1996, 46(4):1105-1112.
Eklund, et al., Evidence for Plasmid-Mediated Toxin and Bacteriocin Production in Clostridium Botulinum Type G, Applied and Environmental Microbiology, 1988, 54(6):1405-1408.
Eklund, et al., Outgrowth and Toxin Production of Nonproteolytic Type B Clostridium Botulinum at 3.3 to 5.6 C, Journal of Bacteriology, 1967, 93(4):1461-1462.
Franciosa, et al., Differentiation of the Gene Clusters Encoding Botulinum Neurotoxin Type A Complexes in Clostridium Botulinum Type A, Ab, and A(B) Strains, Applied and Environmental Microbiology, 2004, 70(12):7192-7199.
Franciosa, et al., Evidence that Plasmid-Borne Botulinum Neurotoxin Type B Genes Are Widespread Among Clostridium Botulinum Serotype B Strains, PLoS One, 2009, 4(3):e4829, pp. 1-9.

(Continued)

*Primary Examiner* — Nancy Treptow
(74) *Attorney, Agent, or Firm* — Quarles & Brady, LLP

(57) ABSTRACT

The present invention provides novel *C. botulinum* conjugatively transmissible plasmids and methods of use thereof. Specifically, described herein are novel, conjugatively transmissible clostridial plasmids which are capable of being transferred among and between clostridial species. The novel plasmids of the present invention therefore permits the delivery of heterologous clostridial genes into a clostridial host, such as *C. botulinum*, and the expression of genes of interest in that host, including clostridial toxins and the nontoxigenic components of the toxin complex, toxin fragments, or antigenic portions thereof, in a way both that ensures abundant expression and facilitates purification. Furthermore, toxins with altered structures, chimeric, hybrid toxins, and other toxin derivatives valuable in medicine could be synthesized in this system.

14 Claims, 22 Drawing Sheets

(56) References Cited

OTHER PUBLICATIONS

Gimenez, et al., New Strains of Clostridium Botulinum Subtype Af, Zbl. Bakt. Hyg., I. Abt. Orig. A, 1978, 240:215-220.
Gimenez, et al., Identification of Strain B 657 of Clostridium Botulinum, Revista Argentina de Microbiologia, 1983, 15(1):51-55.
Gimenez, et al., Characterization of the Neurotoxin Isolated from a Clostridium Baratii Strain Implicated in Infant Botulism, Infection and Immunity, 1992, 60(2):518-522.
Hall, et al., Isolation of an Organism Resembling Clostridium Barati Which Produces Type F Botulinal Toxin from an Infant With Botulism, Journal of Clinical Microbiology, 1985, 21(4):654-655.
Harvey, et al., Botulism Due to Clostridium Baratti Type F Toxin, Journal of Clinical Microbiology, 2002, 40 (6):2260-2262.
Hatheway, Toxigenic Clostridia, Clinical Microbiology Reviews, 1990, 3(1):66-98.
Hatheway, et al., Examination of Feces and Serum for Diagnosis of Infant Botulism in 336 Patients, Journal of Clinical Microbiology, 1987, 25(12):2334-2338.
Hatheway, et al., Atypical Toxin Variant of Clostridium Botulinum Type B Associated with Infant Botulism, Journal of Clinical Microbiology, 1981, 14(6):607-611.
Hauser, et al., Plasmid Localization of a Type E Botulinal Neurotoxin Gene Homologue in Toxigenic Clostridium Butyricum Strains, and Absence of This Gene in Non-Toxigenic C. Butyricium Strains, FEMS Microbiology Letters, 1992, 99:251-256.
Heap, et al., The ClosTron: Mutagenesis in Clostridium Refined and Streamlined, Journal of Microbiological Methods, 2010, 80:49-55.
Heap, et al., A Modular System for Clostridium Shuttle Plasmids, Journal of Microbiological Methods, 2009, 78:79-85.
Heap, et al., The ClosTron: A Universal Gene Knock-Out System for the Genus *Clostridium*, Journal of Microbiological Methods, 2007, 70:452-464.
Hill, et al., Genetic Diversity Among Botulinum Neurotoxin-Producing Clostridial Strains, Journal of Bacteriology, 2007, 189(3):818-832.
Hill, et al., Recombination and Insertion Events Involving the Botulinum Neurotoxin Complex Genes in Clostridium Botulinum Types A, B, E and F and Clostridium Butyricum Type E Strains, BMC Biology, 2009, 7:66, pp. 1-18.
Hughes, et al., Epsilon-Toxin Plasmids of Clostridium Perfringens Type D Are Conjugative, Journal of Bacteriology, 2007, 189(21):7531-7538.
Hutson, et al., Genetic Characterization of Clostridium Botulinum Type A Containing Silent Type B Neurotoxin Gene Sequences, Journal of Biological Chemistry, 1996, 271:10786-10792.
Jacobson, et al., Phylogenetic Analysis of Clostridium Botulinum Type A by Multi-Locus Sequence Typing, Microbiology, 2008, 154(Pt 8):2408-2415.
Johnson, et al., Characterization of Clostridium Botulinum Strains Associated with an Infant Botulism Case in the United Kingdom, Journal of Clinical Microbiology, 2005, 43(6):2602-2607.
Johnson, et al., Characterization of Neurotoxin Mutants in Clostridium Botulinum Type A., Clinical Infectious Diseases, 1997, 25(Suppl 2):S168-S170.
Jovita, et al., Gene Organization and Sequence Determination of the Two Botulinum Neurotoxin Gene Clusters in Clostridium Botulinum Type A(B) Strain NCTC 2916, Current Microbiology, 1998, 36:226-231.
Lin, et al., Transposon Tn916 Mutagenesis in Clostridium Botulinum, Applied and Environmental Microbiology, 1991, 57(10):2946-2950.
Lynt, et al., Differences and Similarities Among Proteolytic and Nonproteolytic Strains of Clostridium Botulinum Types A, B, E and F: A Review, Journal of Food Protection, 1982, 45(5):466-474.
Marshall, et al., Conjugative Botulinum Neurotoxin-Encoding Plasmids in Clostridium Botulinum, PLoS One, 2010, 5(6):e11087, pp. 1-15.
Marshall, et al., Plasmid Encoded Neurotoxin Genes in Clostridium Botulinum Serotype A Subtypes, Biochemical and Biophysical Research Communications, 2007, 361:49-54.
McCroskey, et al., Characterization of an Organism That Produces Type E Botulinal Toxin But Which Resembles Clostridium Butyricum from the Feces of an Infant with Type E Botulism, Journal of Clinical Microbiology, 1986, 23(1):201-202.
McCroskey, et al., Type F Botulism Due to Neurotoxigenic Clostridium Baratii from an Unknown Source in an Adult, Journal of Clinical Microbiology, 1991, 29(11):2618-2620.
Neve, et al., Conjugal Transfer and Characterization of Bacteriocin Plasmids in Group N (Lactic Acid) Streptococci, Journal of Bacteriology, 1984, 157(3):833-838.
Parsons, et al., TcpA, an FtsK/SpoIIIE Homolog, Is Essential for Transfer of the Conjugative Plasmid pCW3 in Clostridium Perfringens, Journal of Bacteriology, 2007, 189(21):7782-7790.
Peck, Biology and Genomic Analysis of Clostridium Botulinum, Advances in Microbial Physiology, 2009, 55:183-265,320.
Raphael, et al., Genetic Homogeneity of Clostridium Botulinum Type A1 Strains with Unique Toxin Gene Clusters, Applied and Environmental Microbiology, 2008, 74(14):4390-4397.
Rood, et al., Identification of a Transferable Tetracycline Resistance Plasmid (pCW3) from Clostridium Perfringens, Plasmid, 1978, 1:563-570.
Rood, Virulence Plasmids of Spore-Forming Bacteria, Plasmid Biology, Chapter 19, ASM Press, Washington D.C., 2004, pp. 413-422.
Sakaguchi, et al., The Genome Sequence of Clostridium Botulinum Type C Neurotoxin-Converting Phage and the Molecular Mechanisms of Unstable Lysogeny, Proc. Natl. Acad. Sci., 2005, 102(48):17472-17477.
Sambrook, et al., Molecular Cloning—A Laboratory Manual, 3rd Ed., 2001, Cold Spring Harbor Laboratory Press, Cold Spring Harbor, NY.
Santos-Buelga, et al., Characterization of the Genes Encoding the Botulinum Neurotoxin Complex in a Strain of Clostridium Botulinum Producing Type B and F Neurotoxins, Current Microbiology, 1998, 37:312-318.
Sayeed, et al., Virulence Plasmid Diversity in Clostridium Perfringens Type D Isolates, Infection and Immunity, 2007, 75(5):2391-2398.
Schantz, et al., Properties and Use of Botulinum Toxin and Other Microbial Neurotoxins in Medicine, Microbiological Reviews, 1992, 56(1):80-99.
Scott, et al., Cryptic Plasmids in Clostridium Botulinum and C. Botulinum-Like Organisms, FEMS Microbiology Letters, 1978, 4:55-58.
Sebaihia, et al., Genome Sequence of a Proteolytic (Group I) Clostridium Botulinum Strain Hall A and Comparative Analysis of the Clostridial Genomes, Genome Research, 2007, 17:1082-1092.
Smedley, et al., The Enteric Toxins of Clostridium Perfringens, Reviews of Physiology, Biochemistry and Pharmacology, 2004, 152:183-204.
Smith, et al., Sequence Variation within Botulinum Neurotoxin Serotypes Impacts Antibody Binding and Neutralization, Infection and Immunity, 2005, 73(9):5450-5457.
Smith, et al., Analysis of the Neurotoxin Complex Genes in Clostridium Botulinum A1-A4 and B1 Strains: BoNT/A3, /Ba4 and /B1 Clusters Are Located Within Plasmids, PLoS One, 2007, 12:e1271, pp. 1-10.
Strom, et al., Plasmids in Clostridium Botulinum and Related Clostridium Species, Applied and Environmental Microbiology, 1984, 48(5):956-963.
Umeda, et al., Genetic Characterization of Clostridium Botulinum Associated with Type B Infant Botulism in Japan, Journal of Clinical Microbiology, 2009, 47(9):2720-2728.
Wang, et al., Genetic Analysis of Type E Botulinum Toxin-Producing Clostridium Butyricum Strains, Applied and Environmental Microbiology, 2000, 66(11):4992-4997.
Zhou, et al., Transfer of Neurotoxigenicity from Clostridium Butyricum to a Nontoxigenic Clostridium Botulinum Type E-Like Strain, Applied and Environmental Microbiology, 1993, 59(11):3825-3831.
Zhou, et al., The Genes for the Clostridium Botulinum Type G Toxin Complex Are on a Plasmid, Infection and Immunity, 1995, 63(5):2087-2091.
PCT International Search Report and Written Opinion, PCT/US2010/052863, Feb. 4, 2011.

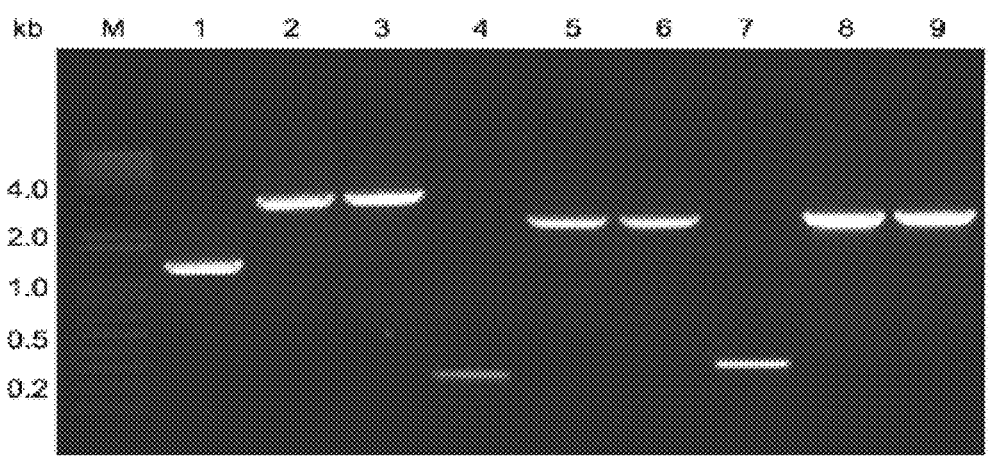
Figure 1
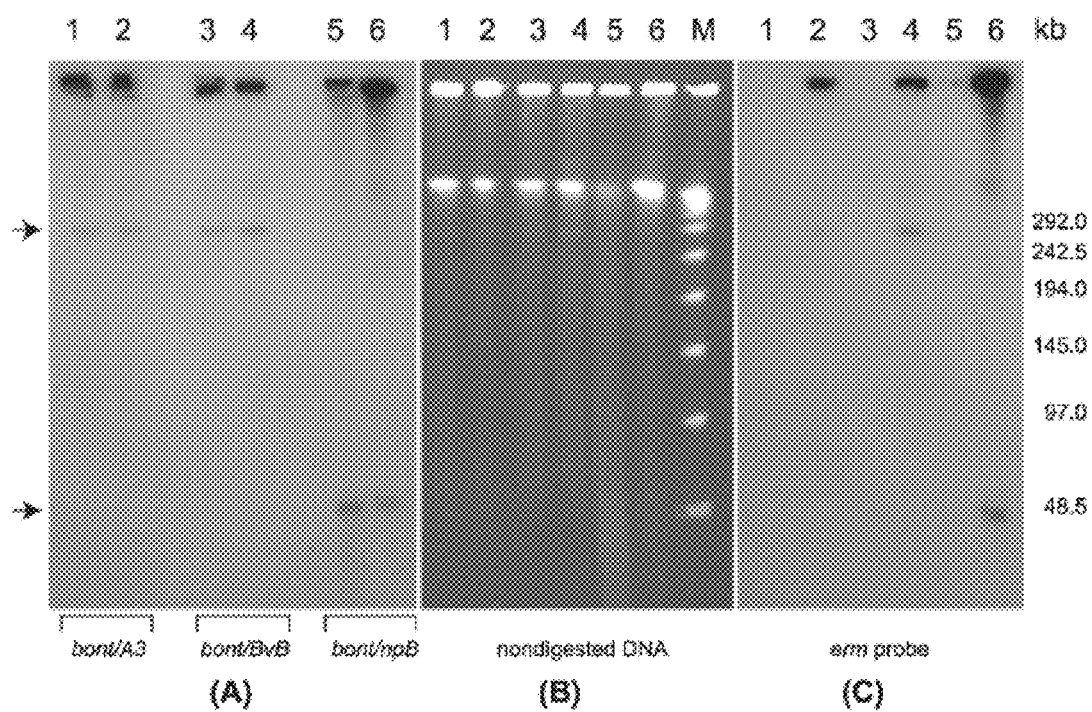
Figure 2 - A-C

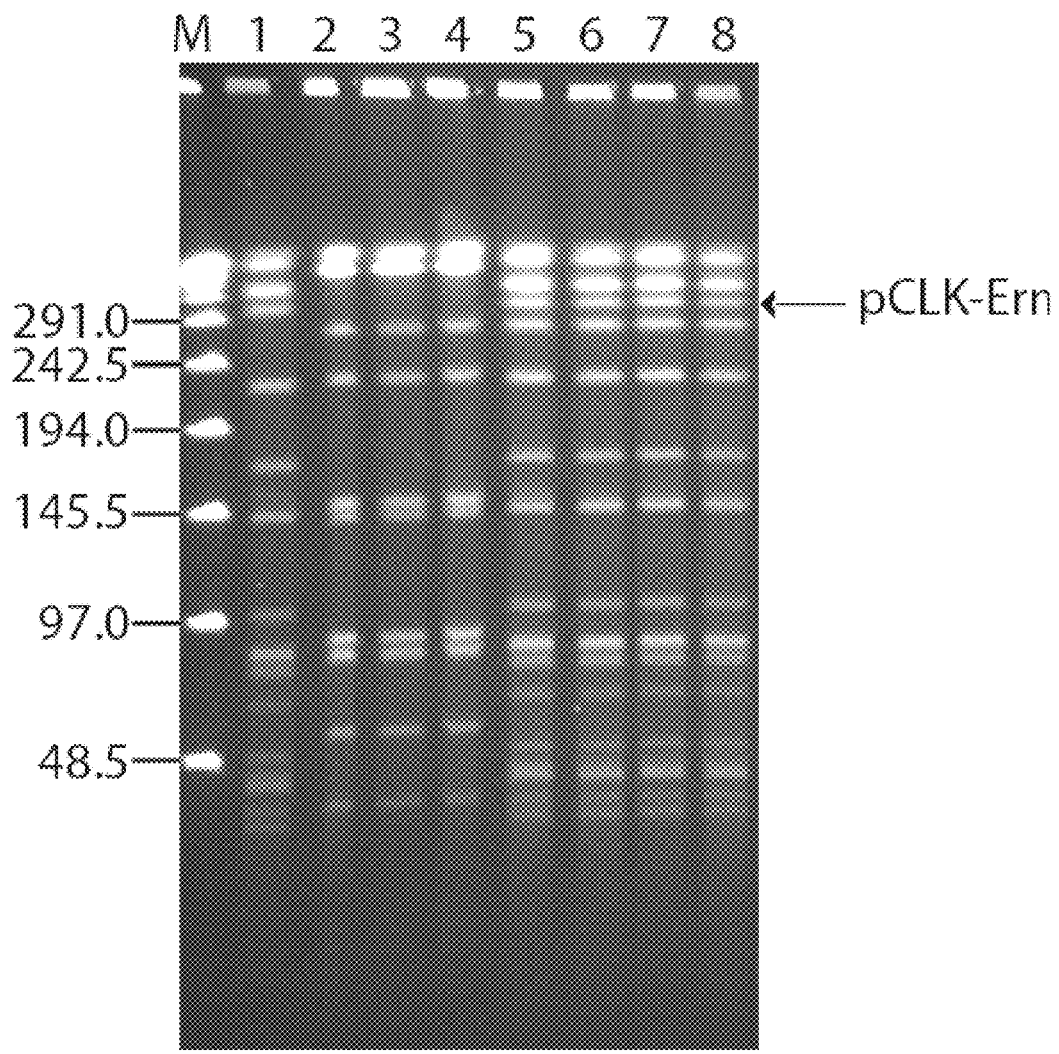
Figure 3 - A

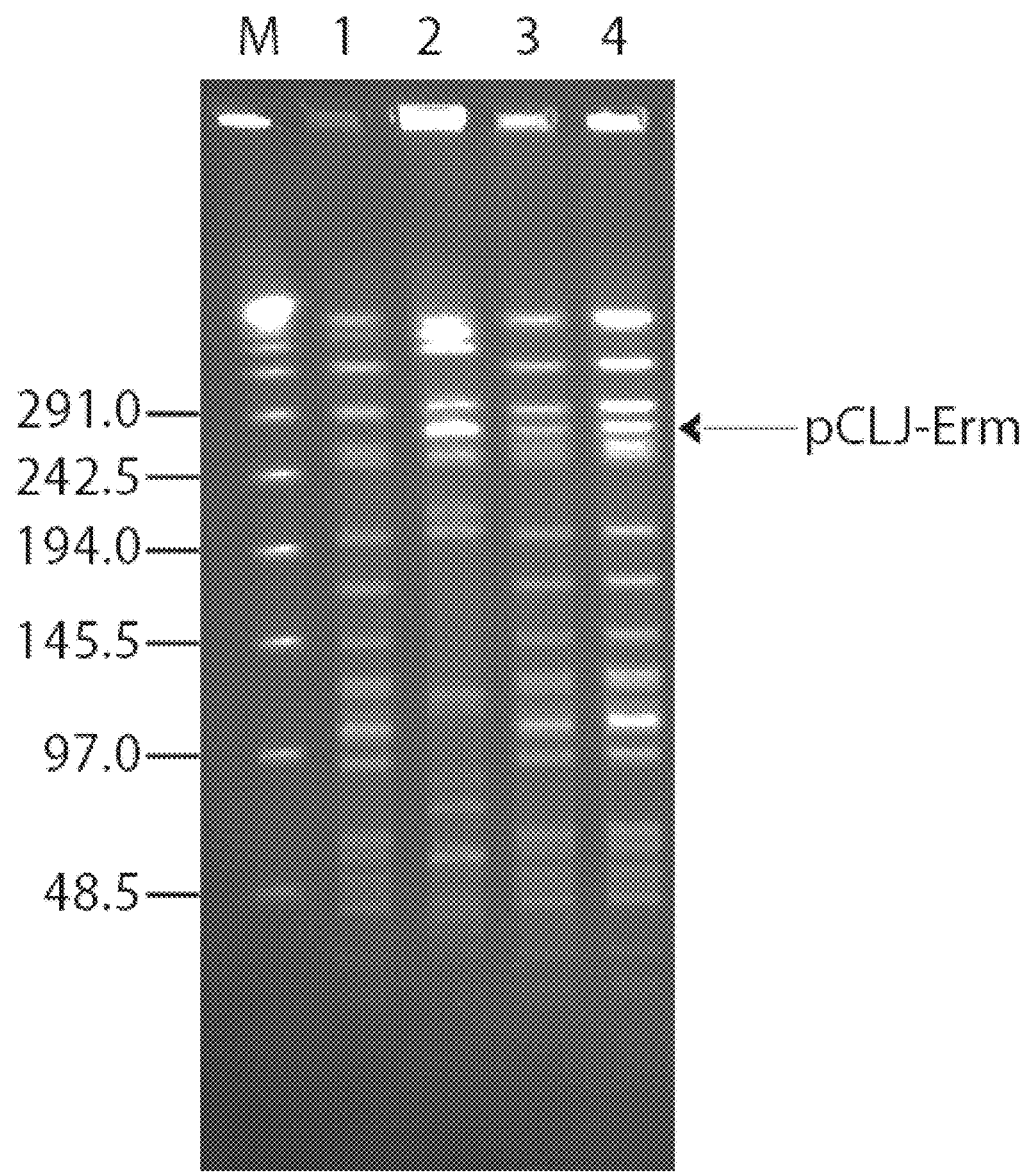
Figure 3 - B

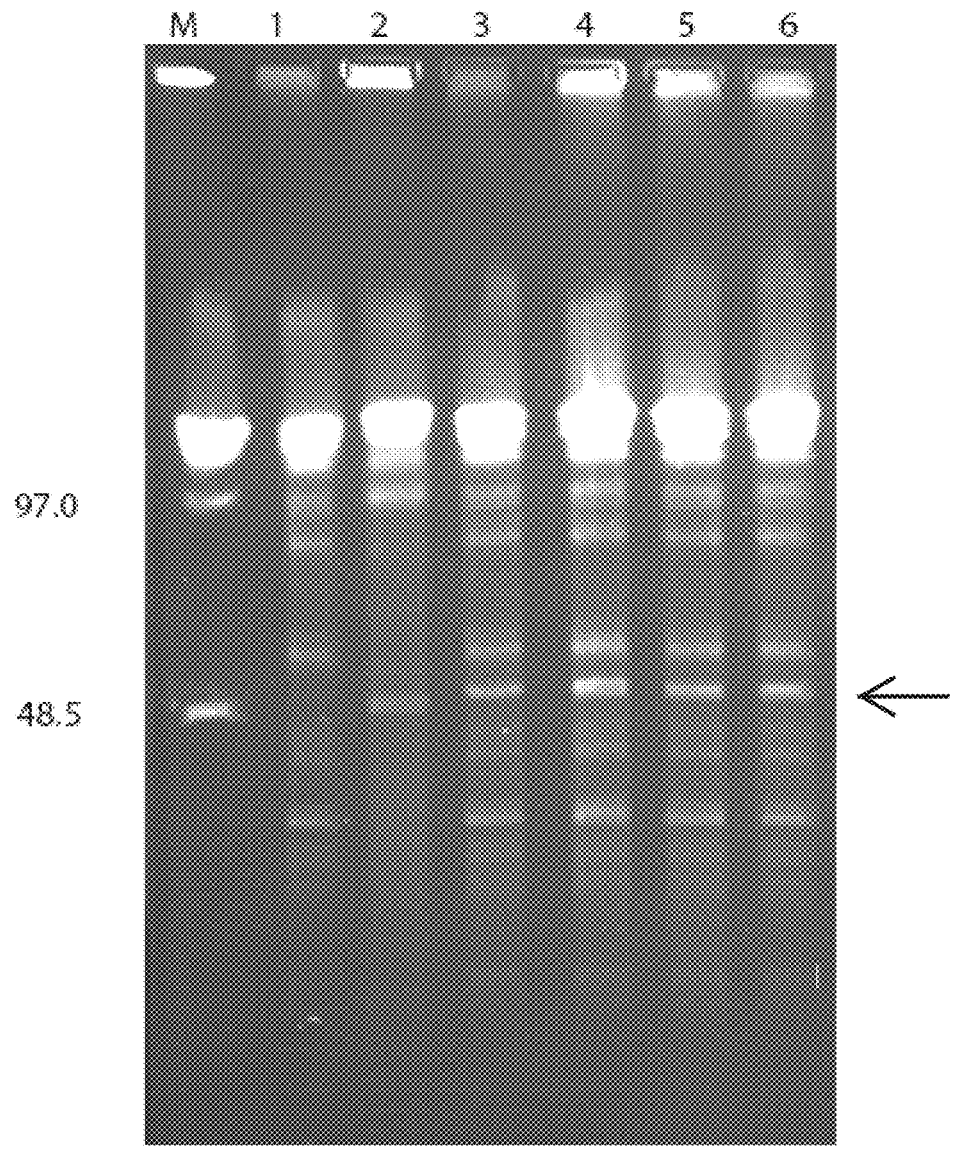
Figure 3 - C

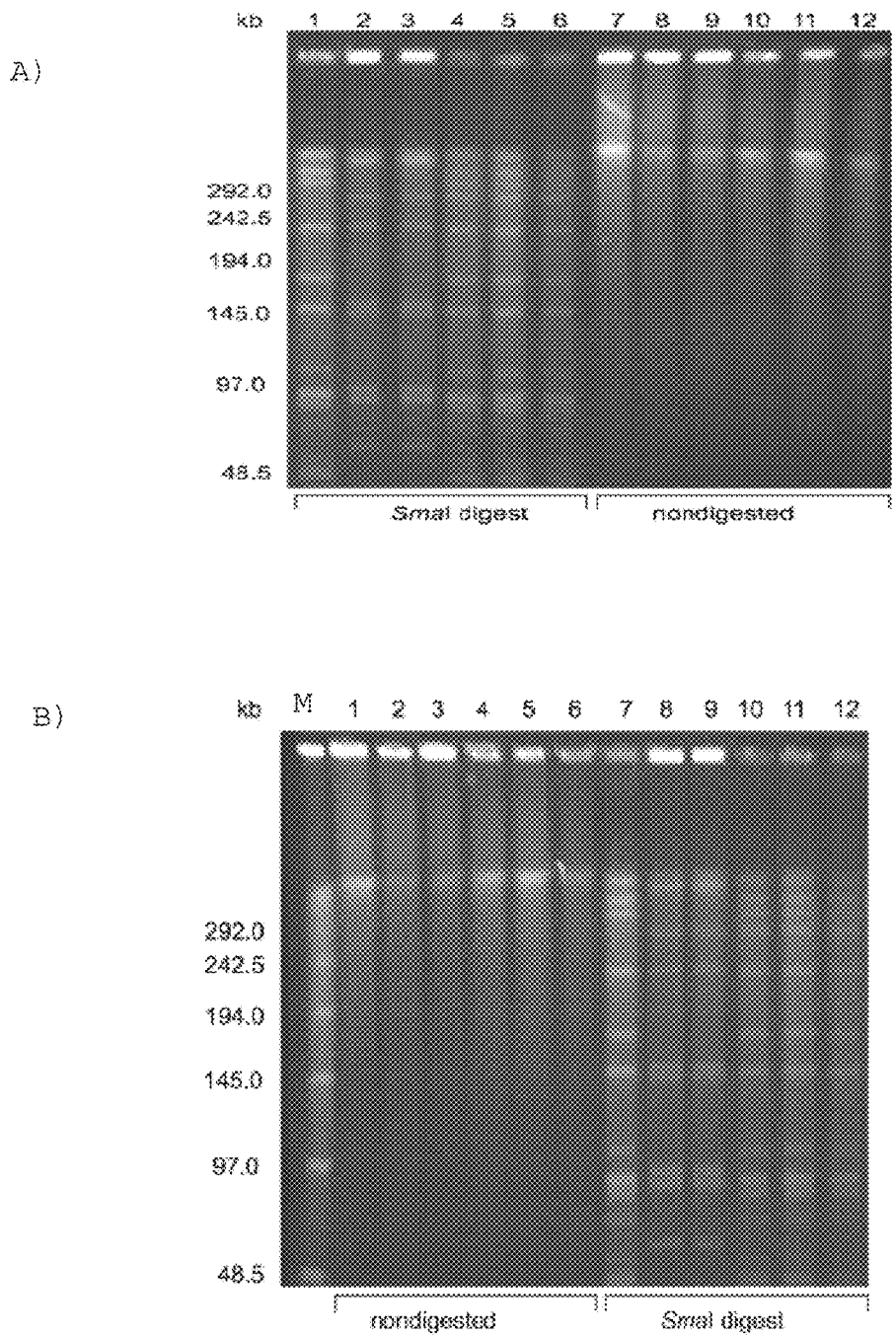
Figure 4 - A-B

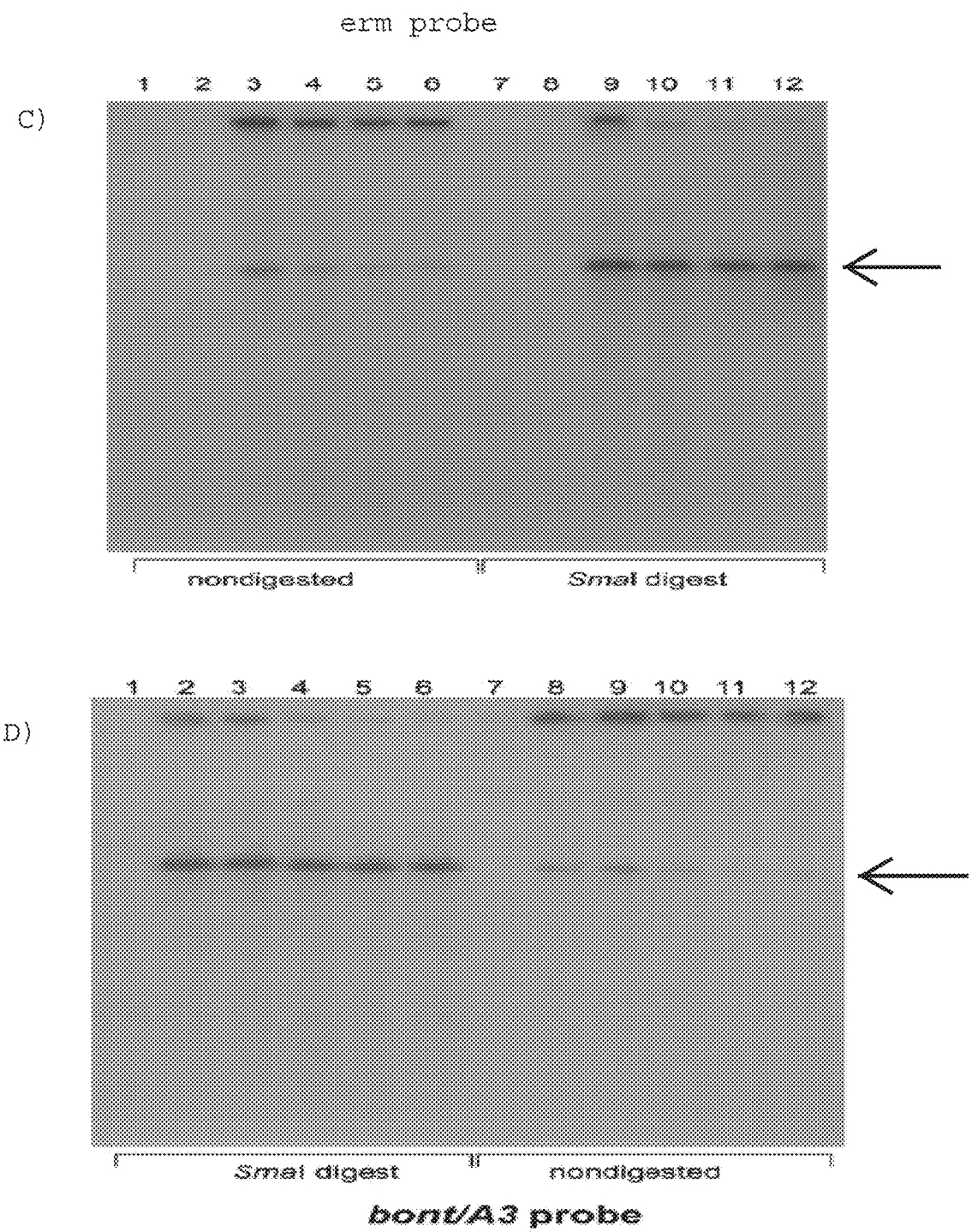
Figure 4 - C-D

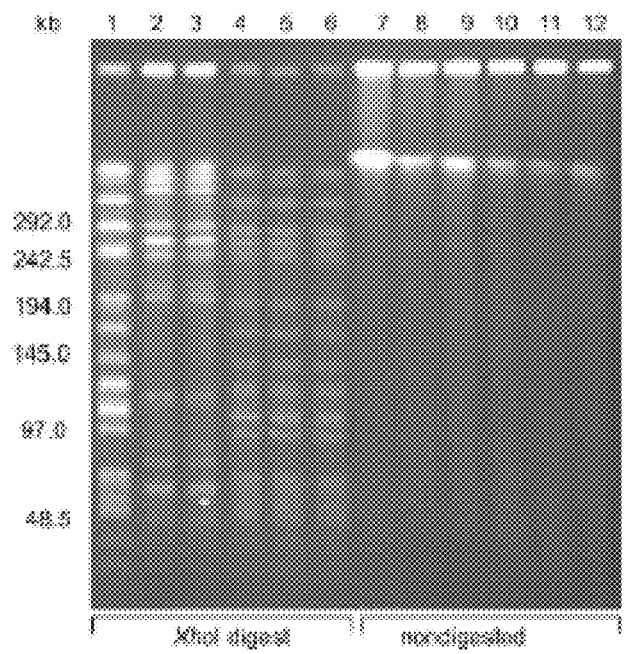
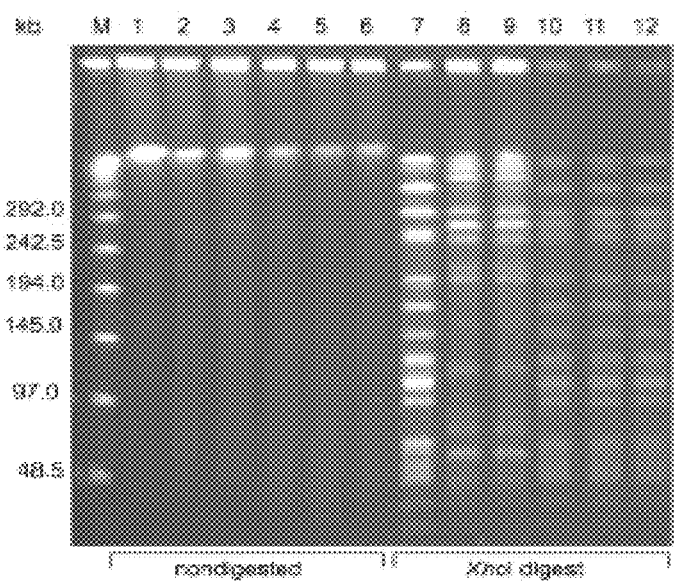
Figure 5 - A

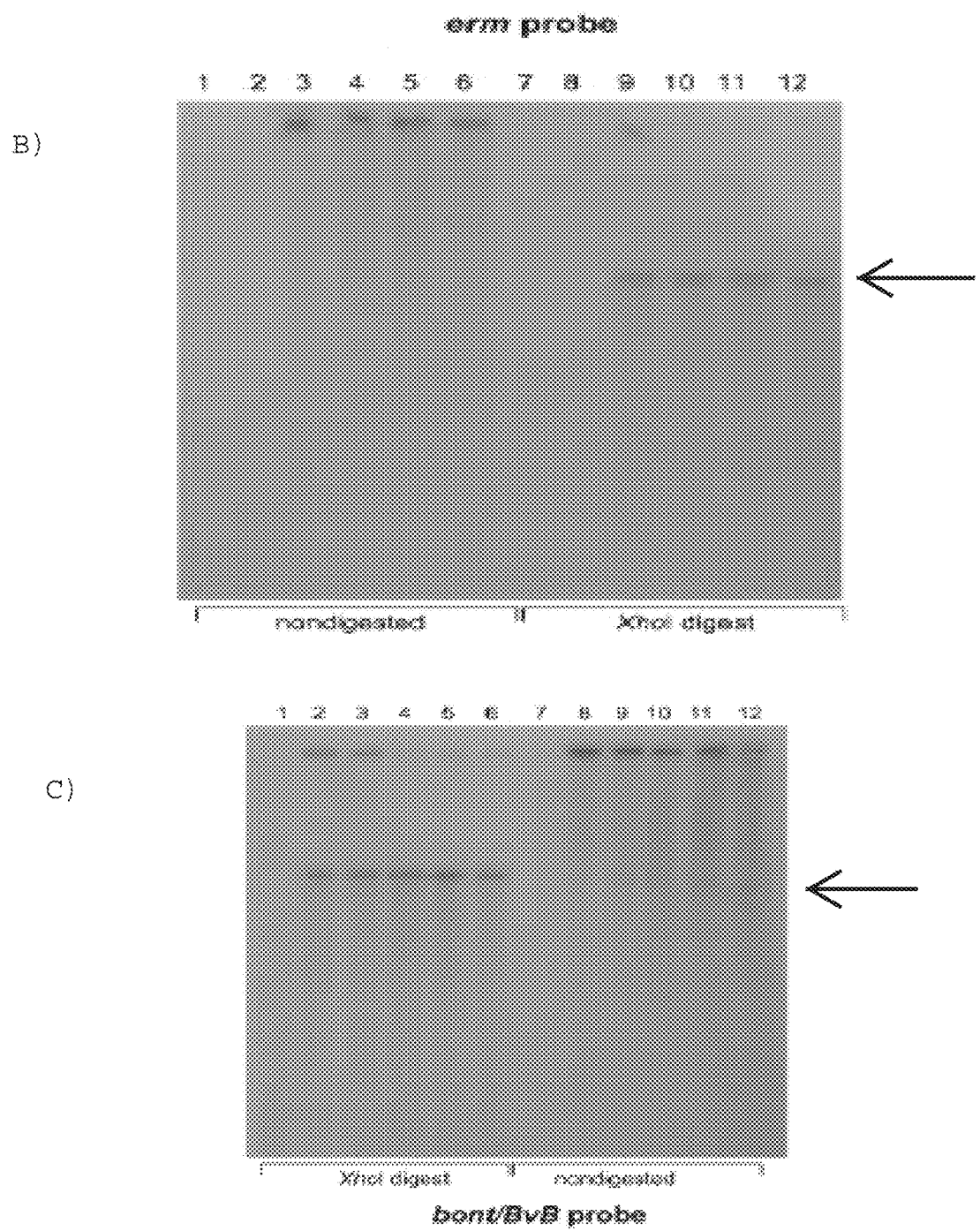
Figure 5 - B-C

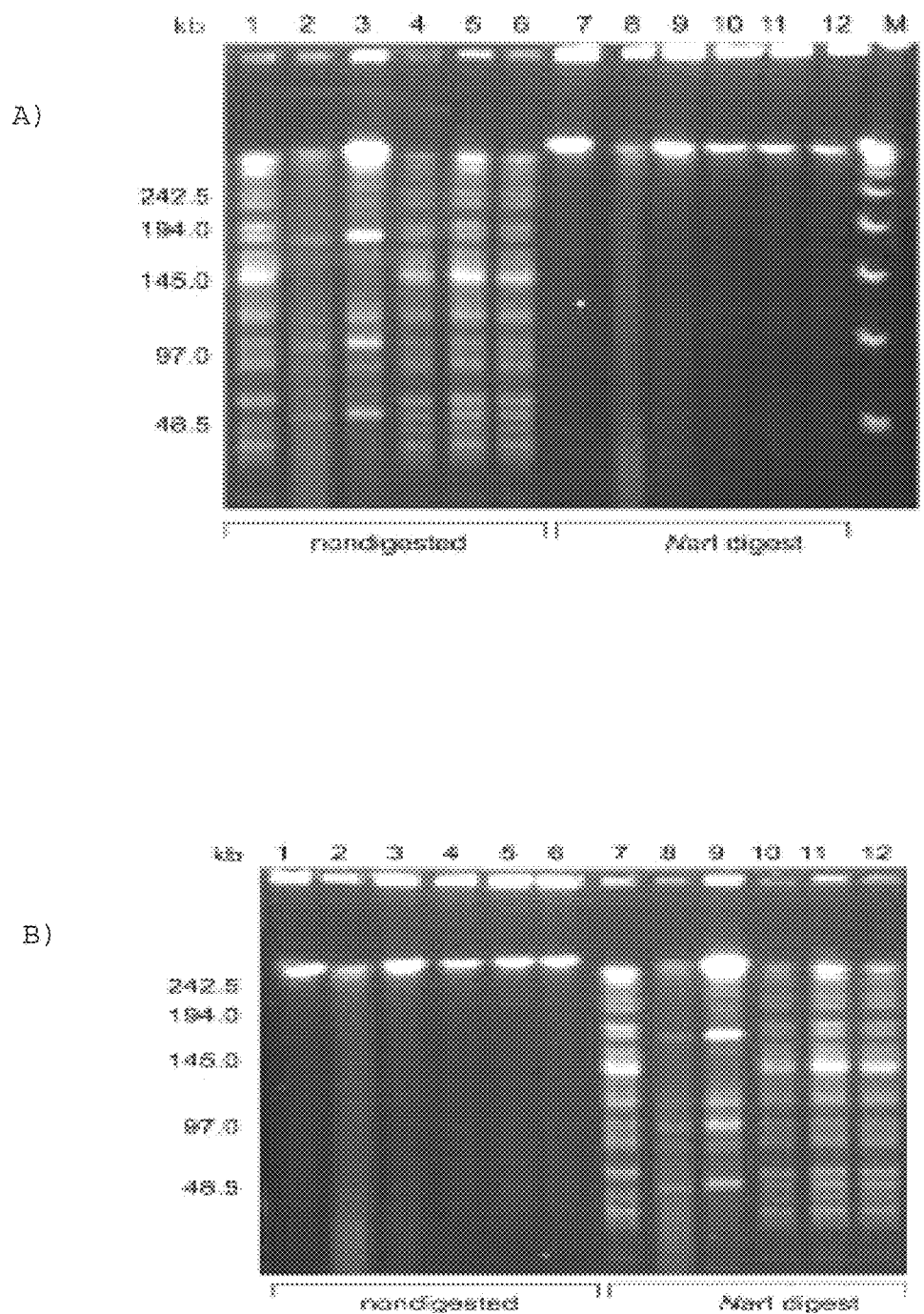
Figure 6 - A-B

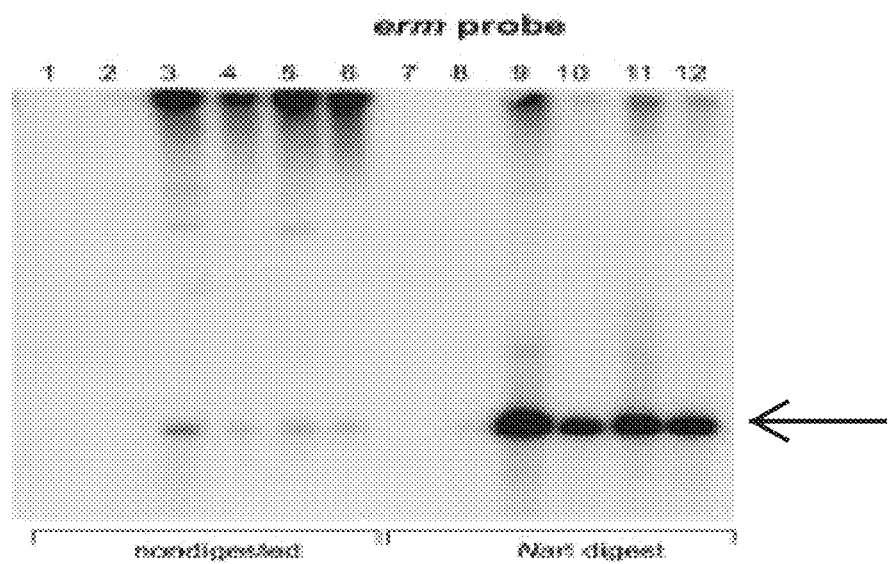
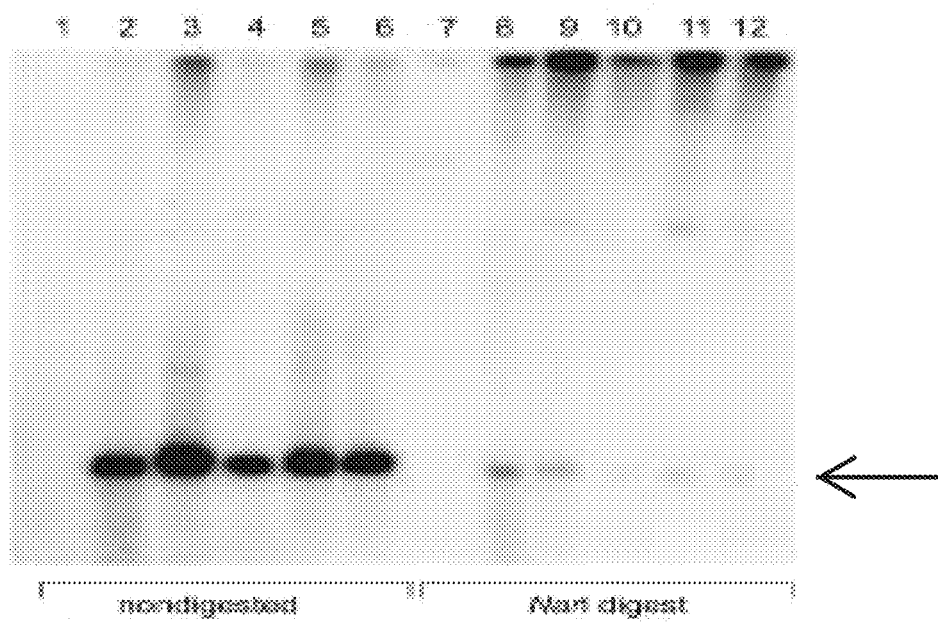
Figure 6 - C-D

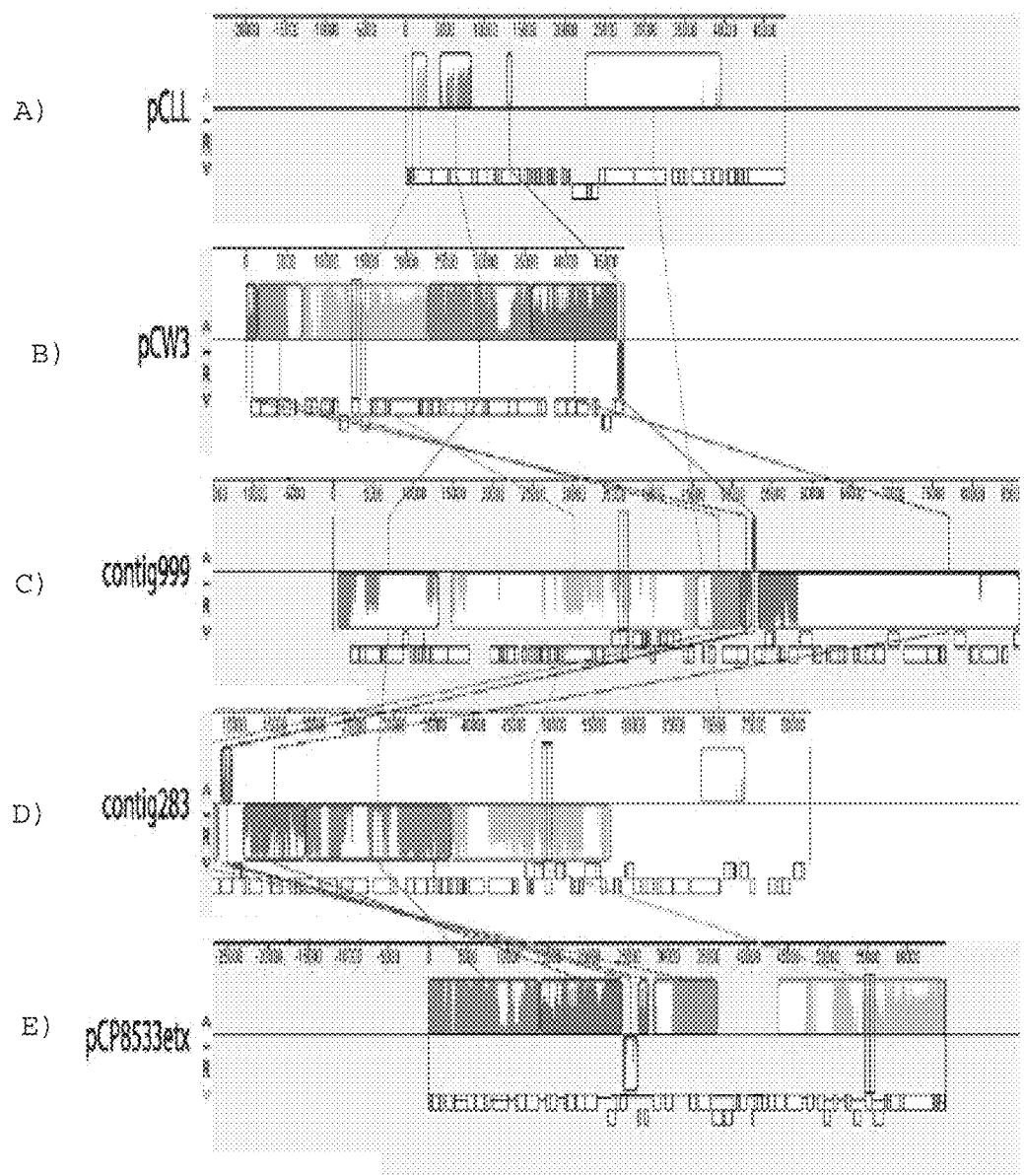
Figure 9 - A-E

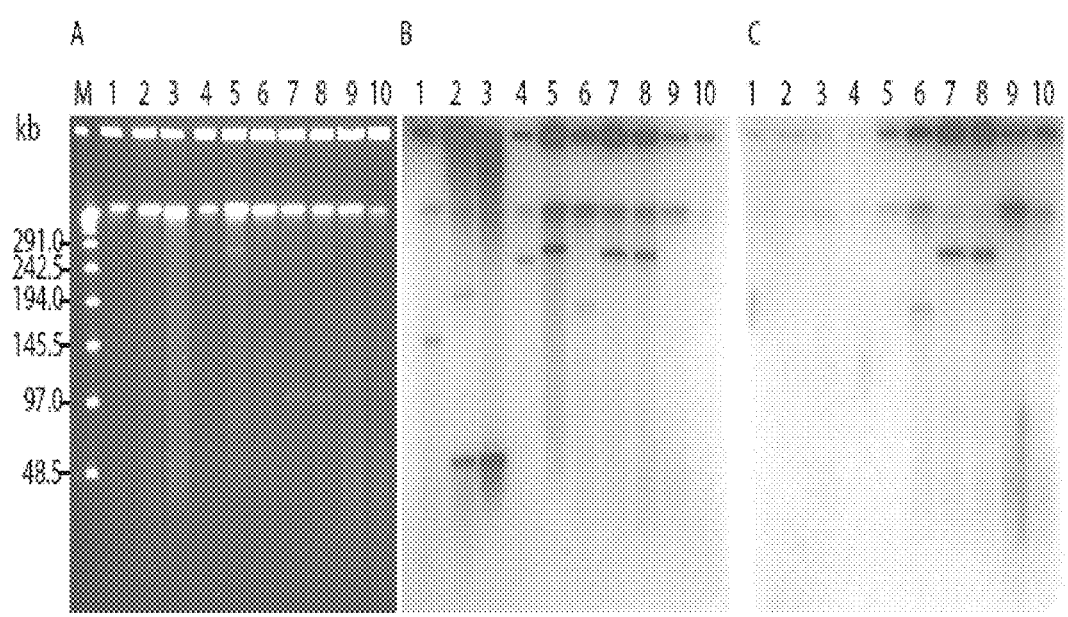
Figure 10 - A-C

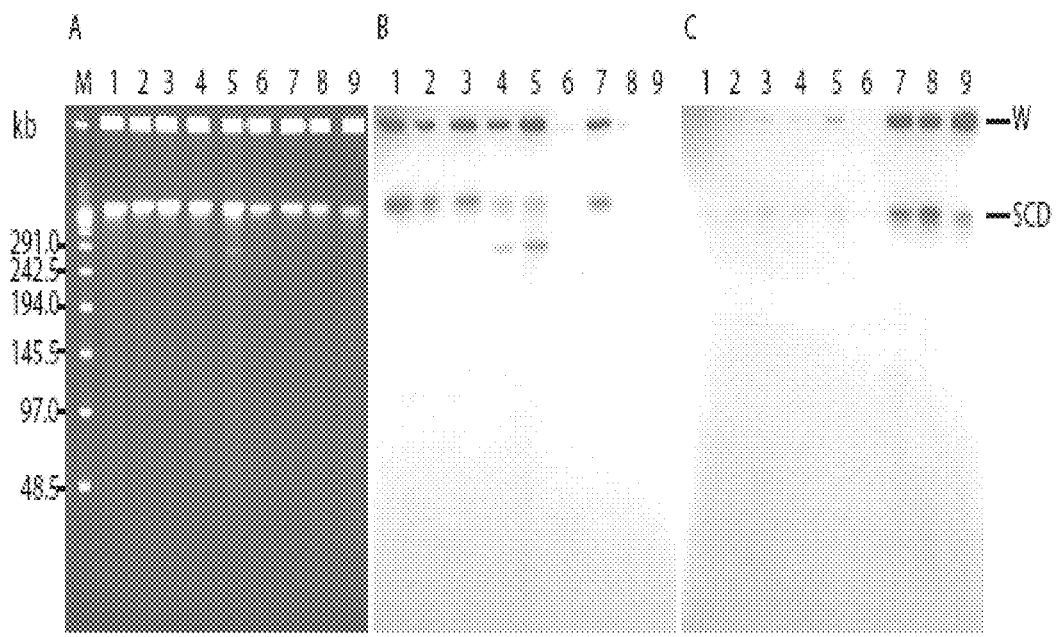
Figure 11 - A-C

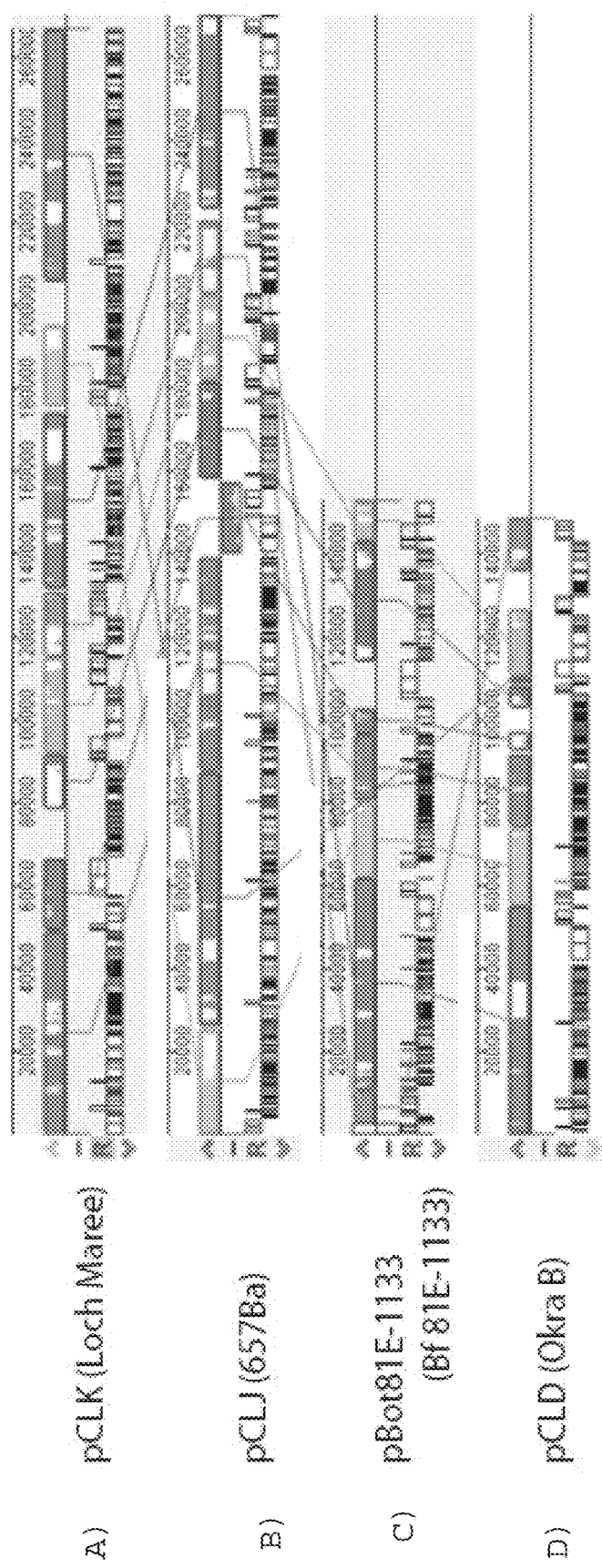
Figure 12 - A-D

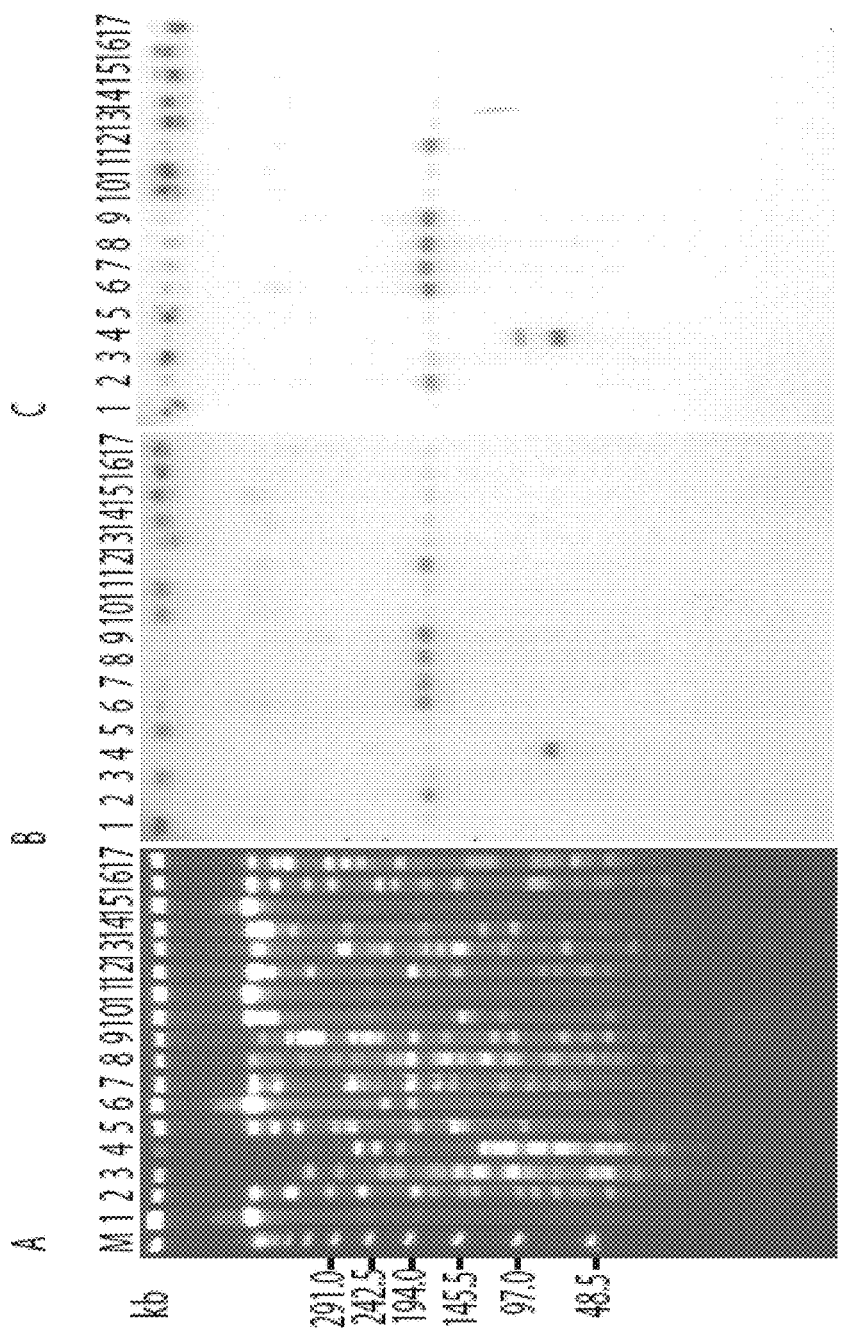
Figure 13 - A-C

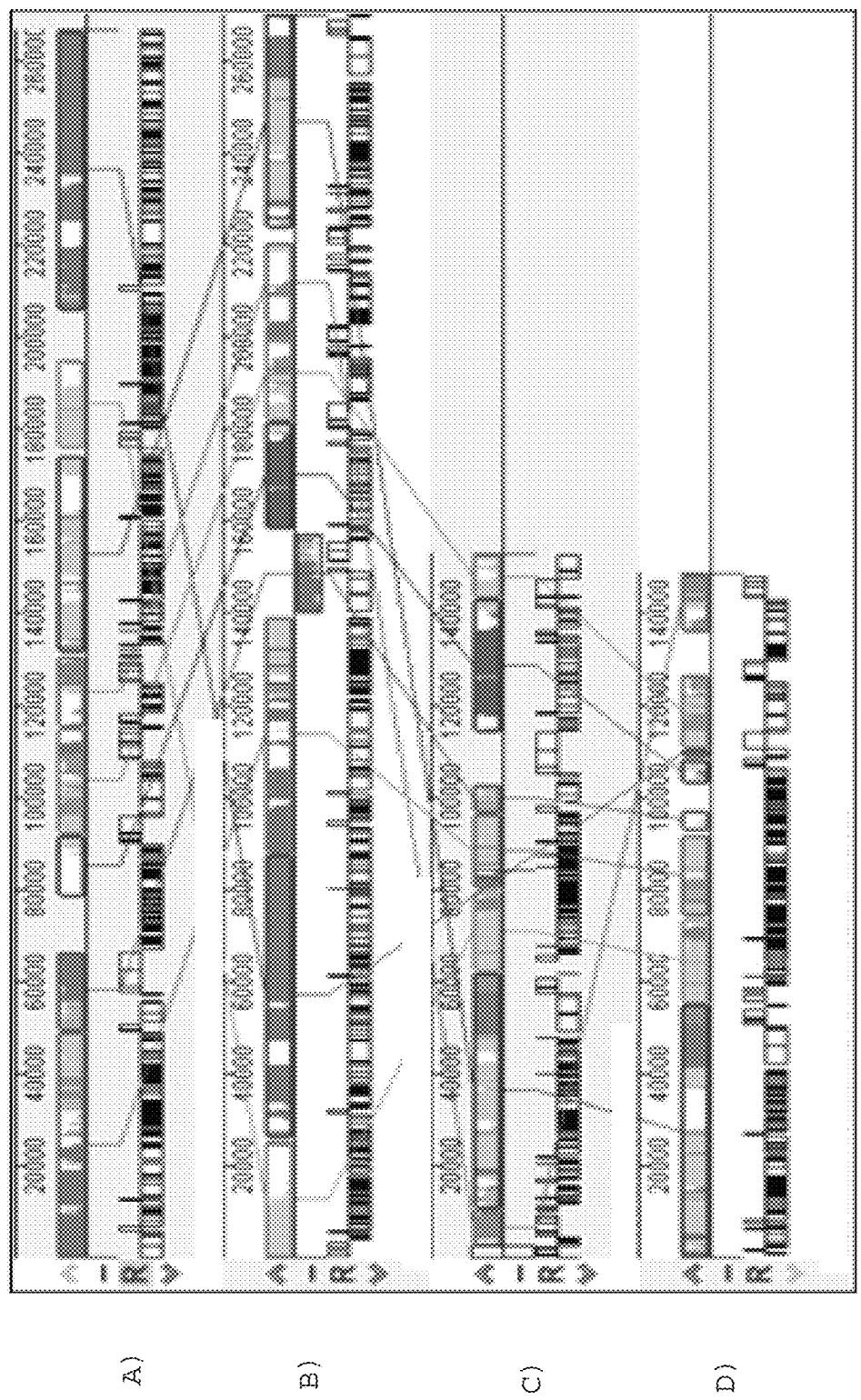
Figure 14 - A-D

Figure 15 - A-F

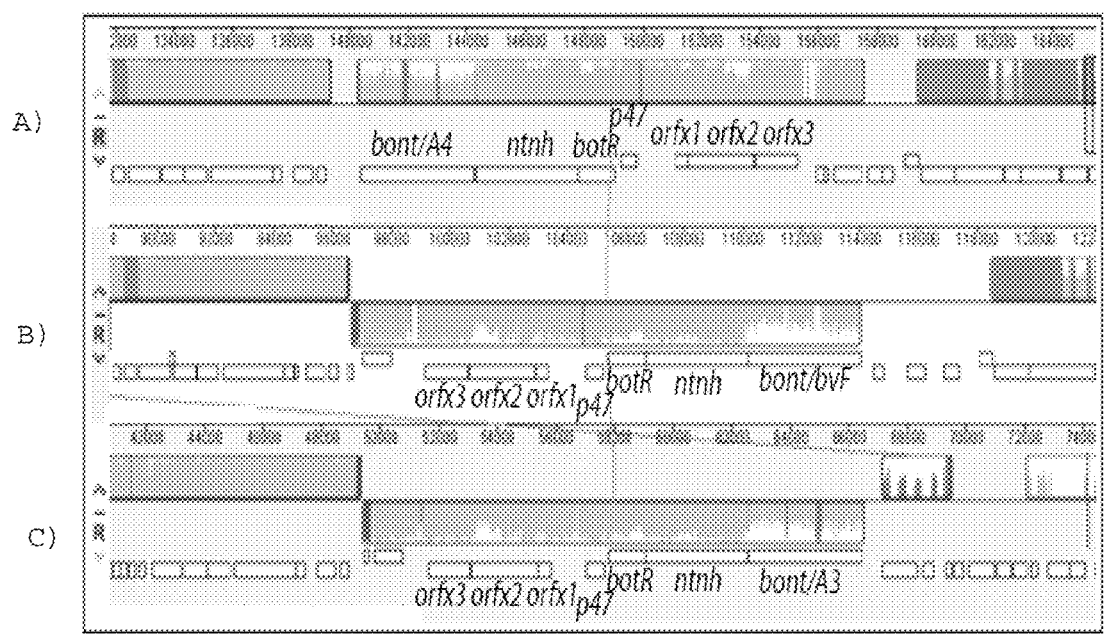
Figure 16 - A-B

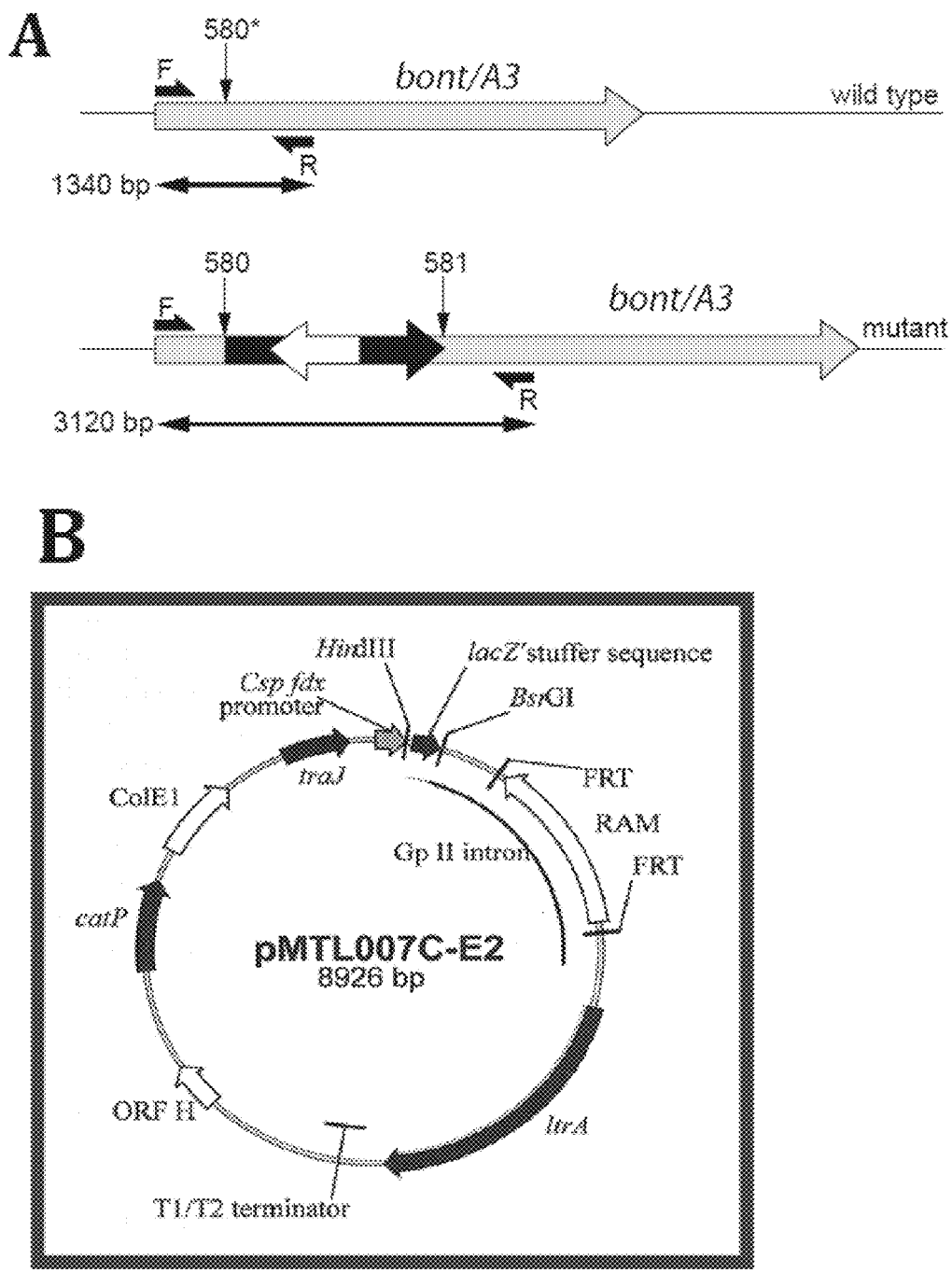
Figure 17 - A-B

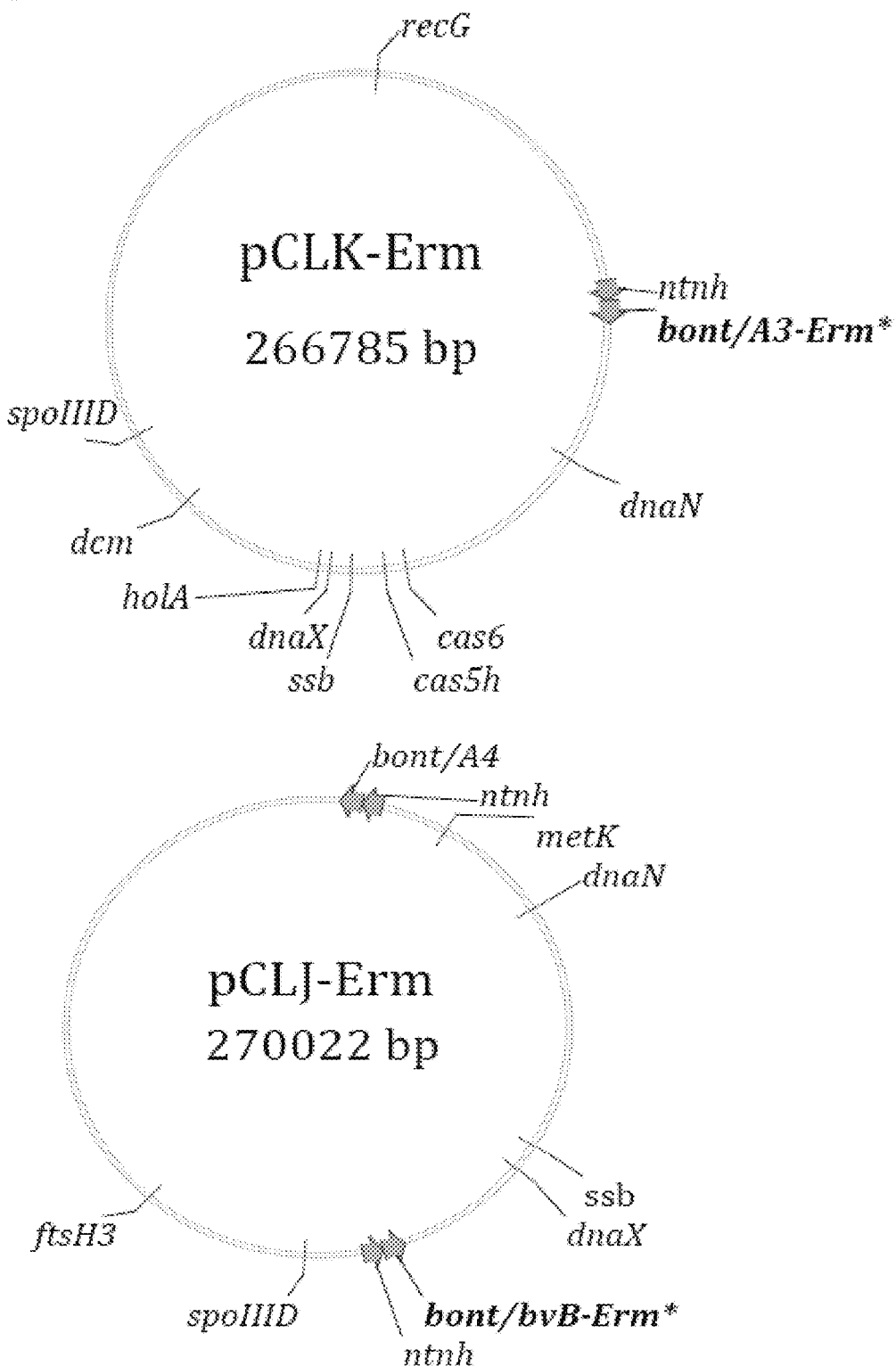
Figure 17 - C

CONJUGATIVE PLASMIDS AND METHODS OF USE THEREOF

CROSS-REFERENCE TO RELATED APPLICATIONS

This application is a continuation application of U.S. patent application Ser. No. 12/905,592, filed Oct. 15, 2010, which claims the benefit of U.S. Provisional Application No. 61/252,029, filed Oct. 15, 2009, both of which are incorporated herein by reference for all purposes.

STATEMENT REGARDING FEDERALLY-SPONSORED RESEARCH OR DEVELOPMENT

The invention was made with government support under Grant Nos. AI-057153 and AI-065359 awarded by the National Institutes of Health. The government has certain rights in the invention.

FIELD OF THE INVENTION

This invention is directed to the conjugal transfer of BoNT-encoding plasmids and their derivatives in *Clostridium botulinum* and discloses technology related to that disclosed in International Patent Application Serial No. WO 2009/006281 filed Jun. 27, 2008, which is hereby incorporated herein by reference for all purposes.

BACKGROUND OF THE INVENTION

Bacteria of the genus *Clostridium* are gram positive and include many pathogenic species responsible for significant mortality and morbidity in both humans and animals. For instance, *Clostridium tetani* is a common soil dwelling organism which produces a neurotoxin responsible for the disease tetanus. *Clostridium perfringens* is a common cause of gas gangrene and food poisoning. *Clostridium difficile* is a common cause of gastroenteritis and pseudomembraneous colitis, particularly among elderly hospital patients who have had their intestinal flora depopulated by treatment with antibiotics.

*Clostridium botulinum* is an anaerobic, gram-positive, spore-forming organism that produces the extraordinarily lethal botulinum neurotoxins (BoNTs), a distinctive neurotoxin of extraordinary potency and the cause of botulism, which can cause severe neuroparalytic illness in humans and animals. BoNT is the etiologic agent of botulism, a paralytic disease resulting from the inhibition of neurotransmitter release at the neuromuscular junction. There are several forms of botulism, and infant and foodborne represent the majority of botulism cases reported in the U. S. Despite the unsavory reputation of BoNTs as a deadly poison and as a potential bioterrorism agent, their use in treatment for numerous hyperactive muscle disorders has been widely demonstrated.

Because of their extreme toxicity, the neurotoxins produced by *Clostridium botulinum* have been the subject of extensive study. Botulinum neurotoxins (BoNT) are classified into seven serotypes, referred to as serotypes A through G, on the basis of their immunological properties. Multiple subtype neurotoxins have been and continue to be discovered especially among serotypes A, B, E and F (Arndt et al. 2006; Carter et al. 2009; Dover et al. 2009; Hill et al. 2007; Smith et al. 2005). In many cases, the amino acid sequences of the toxins have been deduced and compared. See, for example, Minton, "Molecular Genetics of Clostridial Neurotoxins," in Clostridial Neurotoxins, C. Montecucco (Ed.) Springer-Verlag, Berlin (1995).

*Clostridium* strains producing BoNTs are broadly characterized into four groups based on metabolic, physiological and genetic properties (Hatheway 1990). Group I contains proteolytic strains of serotypes A, B and F. Group II contains nonproteolytic strains of serotypes B, E and F. Unlike proteolytic strains, nonproteolytic strains lack the ability to digest meat and milk proteins and rely on exogenous proteins for the proteolytic nicking of the neurotoxin into its active di-chain form (Lynt et al. 1982). Group III includes strains of serotypes C and D and Group IV includes strains of *C. botulinum* serotype G, also referred to as *Clostridium argentinense*.

The genes encoding BoNT serotypes C, D and G have long been established to be associated with extrachromosomal elements (Sakaguchi et al. 2005; Zhou et al. 1995). Specifically, the BoNT/C1 and BoNT/D clusters are carried on bacteriophages, and in *C. botulinum* serotype G, the neurotoxin gene, bont/G, was shown to reside on a large plasmid of ca. 114 kb. However, genes encoding serotypes A, B, E and F were believed to be located on the chromosome. Recently, strains of serotype A, proteolytic and nonproteolytic strains of serotype B, and dual neurotoxin producing Ba, Ab and Bf strains have been shown to harbor neurotoxin genes on very large plasmids (Marshall et al. 2007; Smith et al. 2007; Franciosa et al. 2009). Interestingly, in dual neurotoxin-producing strains of Ba, Ab and Bf subtypes analyzed thus far, it appears that both neurotoxin genes are usually located on the same plasmid. Plasmids identified in proteolytic strains of *C. botulinum* range in size from approximately 150 to 270 kb and several plasmids found in serotypes A and B and dual neurotoxin producing Ba and Bf strains have been shown to be highly conserved, yet they carry different neurotoxin subtype genes. BoNT-encoding plasmids seem to be more prevalent among strains of serotype B than other serotypes. Unlike the large plasmids observed in proteolytic serotype B strains, plasmids found in nonproteolytic B strains are consistently smaller (approximately 48 kb) and share no homology with plasmids of proteolytic *C. botulinum* strains Interest in BoNTs has accelerated due to its potential as pharmaceutical agent for the treatment of segmental movement disorders, spasticity, pain syndromes, and various other neural disorders. In addition, the potential for the use of BoNTs in bioterrorism has been noted and, as a result, government agencies are actively investigating countermeasures against them.

In use, BoNT specifically and tightly binds to cholinergic neurons. BoNT is found natively both in bacterial cultures and in contaminated foods as a progenitor toxin complex in which the neurotoxin is associated with nontoxic components including nontoxic nonhemagglutinin (NTNH), hemagglutinin (HA) proteins, RNA, and other uncharacterized protein components. The neurotoxin component of the toxin complex is a 150 kDa protein comprising a heavy (HC) and a light (LC) chain. The LC contains the catalytic domain that cleaves nerve proteins essential for neurotransmission. Specifically, upon endocytosis and internalization into the nerve terminal, the light chain of the toxin acts to block or slow the exocytotic release of neurotransmitters, particularly acetylcholine. Selective injection of botulinum toxin into neuromuscular regions produces a local weakening of proximal muscles and relief from excessive involuntary muscle contractions. In addition to directly affecting cholinergic neurotransmission, BoNT also exerts other poorly understood effects including altering activity of autonomic ganglia.

Upon endocytosis and internalization into the nerve terminal, the light chain of the toxin acts to block or slow the exocytotic release of neurotransmitters, particularly acetylcholine. Accordingly, the ability of BoNT to specifically target peripheral nerves and its long duration of action make it a very attractive potential therapeutic tool. Complications and drawbacks of botulinum toxin therapy include immunological resistance in some patients and diffusion and resulting apoptosis of neighboring muscles. These side effects can be avoided by proper expression, purification and preparation of the toxin or toxin chains or fragments for pharmaceutical use (Schantz et al. 1992).

BoNT-encoding plasmids carrying neurotoxin genes have been identified in numerous proteolytic and nonproteolytic strains of *C. botulinum* serotypes A and B and in bivalent subtypes Bf and Ab (Marshall et al. 2007; Smith et al. 2007; Franciosa et al. 2008). Although plasmids among proteolytic strains of *C. botulinum* are quite large and tend to vary in size, plasmids found in nonproteolytic *C. botulinum* strains are much smaller and are consistently observed to be approximately 48 kb.

Two main strategies have been utilized to obtain clostridial neurotoxins, individual chains of the toxins, or non-toxigenic components of the toxin complex. The first strategy is to isolate the desired protein itself from cultures of the toxigenic *C. botulinum* strain, and then biochemically separating the chains. However, separating the chains of the purified toxins, or toxin domains, or toxin fragments is technically challenging, laborious, the yields are low. The clinical use of purified botulinum toxin fragments is thus complicated by the need for extreme purity since even minute amounts of any contaminating active toxin can be non-specific and potentially dangerous. Biochemical preparations of toxin chains or fragments are always contaminated with low levels of active neurotoxin.

The second strategy is to recombinantly produce the toxin or toxin fragments in native or heterologous hosts. Unfortunately, the expression of clostridial genes in most heterologous hosts has been found to be inefficient. Available information on clostridial gene expression in *E. coli* in particular, and also other heterologous hosts, indicates that the expression of clostridial genes in these hosts occurs at very low levels and is relatively inefficient, and necessary post-translational modifications such as proteolytic activation and molecular folding to not occur. Furthermore, expression of clostridial proteins in heterologous hosts may result in production of degraded product and/or produced as insoluble matter. Expression of clostridial genes in clostridial species is, as might be expected, more efficient and the resulting proteins are less prone to structural or sequence errors and undergo proper posttranslational modifications.

Handling of and culturing of these bacteria is difficult since not only are they highly toxic, the organisms are obligate anaerobes which die if exposed to oxygen. Therefore, the clostridia must be handled under specialized conditions. These technical difficulties reduce efficiency of approaches that can be used for gene transfer in other bacteria such as electroporation, transformation and transduction. For instance, currently used clostridial shuttle vectors are constructed using replication genes from small (less than 10 kb) cryptic clostridial plasmids such as pIP404 (*C. perfringens*), pCD6 (*C. difficile*, pCB102 (*C. butyricum*), pBP1 (*C. botulinum*) or from small plasmids (2.4-25.5 kb) isolated from *E. faecalis* (pAMβ1), *B. subtilis* (pIM13) (Davis et al. 2005; Heap et al. 2009). Besides the replication genes functional in clostridia, these vectors also contain an antibiotic resistance gene functional in both clostridia and *E. coli*, and these plasmids can be transferred to clostridial strains by electroporation. For instance, vectors that additionally contain *E. coli* oriT sequences can be introduced into clostridial strains by conjugation from a suitable *E. coli* donor strain, but there are technical difficulties as described below.

In general, these vectors can be transferred to clostridial strains and are maintained in these strains in the presence of the antibiotic that is encoded from the plasmid vector. Transfer efficiency of these vectors varies and is strain dependent. However, these plasmids are not designed to maintain large gene inserts, e.g. larger than approximately 4 kb. Therefore, they cannot be used for transfer of gene clusters such as botulinum neurotoxin clusters that are 12-16 kb. However, botulinum neurotoxins are naturally produced as protein complexes consisting of a neurotoxin associated with several nontoxigenic components. The complex protects the neurotoxin in the host cell as well as in the human/animal gut. In order to increase the yield and production of high quality botulinum neurotoxins, vectors that can transfer large gene clusters are necessary.

Accordingly, the study and the production of clostridial toxin genes as well as other clostridial genes organized in gene clusters would be greatly facilitated by a plasmid providing the conjugal transfer of BoNT-encoding plasmids in other *Clostridium* species, thereby providing a plasmid and method for the widespread distribution of BoNT-encoding plasmids in other *Clostridium* species, especially *Clostridium* species that do not naturally produce these gene products.

SUMMARY OF THE INVENTION

The invention provides a novel conjugative transfer plasmid comprising: an origin of replication effective in *Clostridium* species; a protein coding sequence for a gene of interest operably joined to a promoter effective in *Clostridium* species; and an origin of conjugative transfer capable of modulating the conjugative transfer of the plasmid into a recipient *Clostridium* species, wherein the gene of interest is expressed in the recipient *Clostridium* species.

In one embodiment, the gene of interest is a botulinum neurotoxin gene for expressing clostridial toxins, toxin fragments, or antigenic portions thereof. The gene of interest may be from the same *Clostridium* species as the recipient *Clostridium* species or from a different *Clostridium* species.

In one embodiment, the plasmid may be selected from any donor *Clostridium* species. For instance, the plasmid may be found on *C. botulinum* strains selected from the group consisting of serotypes A, B, C, D, E, F or G. Alternatively, the plasmid may be from *C. botulinum* strains selected from the group consisting of Ba, Ab, Bf, Af or A(B). The plasmid may be from the same *Clostridium* species as the recipient *Clostridium* species or from a different *Clostridium* species. In one embodiment, the plasmid is selected from the group consisting of pBotCDC-A3, pCLJ, pCLL, pBot81E-1133 and pCLD.

In one embodiment, the promoter effective in *Clostridium* species is NTNH-BoNT promoter from *C. botulinum*.

In one embodiment, the recipient *Clostridium* species is toxic or nontoxic, such as LNT01 or Hall A-Hyper. The recipient *Clostridium* species may also be proteolytic or nonproteolytic.

In one embodiment, the conjugative transfer plasmid further comprises an antibiotic resistant gene that confers resistance to the recipient *Clostridium* species to erythromycin, kanamycin, ampicillin, tetracycline, chloramphenicol, spectinomycin, gentamycin, zeomycin or streptomycin. In one embodiment, the conjugative transfer plasmid further comprises an antibiotic resistant gene for conferring resistance to the recipient *Clostridium* species to erythromycin, tetracycline, chloramphenicol or thiamphenicol.

In an alternate embodiment, the present invention provides a novel conjugative transfer plasmid comprising a BoNT-encoding plasmid containing an origin of replication effective in *Clostridium* species, the BoNT encoded by the plasmid operably joined to a promoter effective in the *Clostridium* species; and an origin of conjugative transfer capable of modulating the conjugative transfer of the BoNT-encoding plasmid into a recipient *Clostridium* species, wherein the BoNT encoded by the plasmid is expressed in the recipient *Clostridium* species.

In one embodiment, the BoNT-encoding plasmid may be selected from any donor *Clostridium* species. For instance, the BoNT-encoding plasmid may be selected from *C. botulinum* serotypes A, B, C, D, E, F or G. Alternatively, the plasmid may be selected from *C. botulinum* strains Ba, Ab, Bf, Af or A(B). The BoNT-encoding plasmid may be from the same *Clostridium* species as the recipient *Clostridium* species or from a different *Clostridium* species. In one embodiment, BoNT-encoding plasmid is selected from the group consisting of pBotCDC-A3, pCLJ, pCLL, pBot81E-1133 and pCLD.

In one embodiment, the BoNT encoded by the plasmid is a botulinum neurotoxin gene for expressing clostridial toxins, toxin fragments, or antigenic portions thereof. The BoNT encoded by the plasmid may be from the same *Clostridium* species as the recipient *Clostridium* species or from a different *Clostridium* species.

In one embodiment, the BoNT-encoding plasmid further comprises an antibiotic resistant gene confers resistance to the recipient *Clostridium* species to erythromycin, tetracycline, chloramphenicol, and others known to be encoded from a plasmid. Where the recipient *Clostridium* species is *C. botulinum*, the antibiotic resistant gene confers resistance to the recipient *Clostridium* species to erythromycin, tetracycline, chloramphenicol or thiamphenicol.

In an alternate embodiment, the present invention provides a novel method of conjugatively transferring a gene of interest into a recipient *Clostridium* species. The method comprises conjugatively transferring a plasmid comprising an origin of replication effective in *Clostridium* species, a protein coding sequence for a gene of interest operably joined to a promoter effective in *Clostridium* species, and an origin of conjugative transfer capable of modulating the conjugative transfer of the plasmid into the recipient *Clostridium* species, wherein the gene of interest encoded by the plasmid is expressed in the recipient *Clostridium* species.

In one embodiment, the gene of interest is a botulinum neurotoxin gene for expressing clostridial toxins, toxin fragments, or antigenic portions thereof. The gene of interest may be from the same *Clostridium* species as the recipient *Clostridium* species or from a different *Clostridium* species.

While multiple embodiments are disclosed, still other embodiments of the present invention will become apparent to those skilled in the art from the following detailed description. As will be apparent, the invention is capable of modifications in various obvious aspects, all without departing from the spirit and scope of the present invention. Accordingly, the detailed descriptions are to be regarded as illustrative in nature and not restrictive.

BRIEF DESCRIPTION OF THE FIGURES

FIG. 1. Confirmation of tagging *C. botulinum* BoNT-encoded plasmids pBotCDC-A3-Erm (strain CDC-A3), pCLJ-Erm (strain 657Ba) and pCLL-Erm (strain Eklund 17B) by PCR analysis. PCR products of wild-type *C. botulinum* strains CDC-A3 (Lane 1), 657Ba (Lane 4) and Eklund 17B (Lane 7) and two erythromycin resistant, thiamphenicol sensitive clones of each of CDC-A3 (Lanes 2 and 3), 657Ba (Lanes 5 and 6) and Eklund 17B (Lanes 8 and 9) strains; 1 kb Plus ladder (Invitrogen) (Lane M).

FIG. 2. Confirmation of tagging *C. botulinum* BoNT-encoding plasmids pBotCDC-A3-Erm (strain CDC-A3), pCLJ-Erm (strain 657Ba) and pCLL-Erm (strain Eklund 17B) by PFGE and Southern hybridization analysis. (B) Ethidium bromide stained PFGE of nondigested DNA samples from *C. botulinum* strains: wild type CDC-A3 (Lane 1), CDC-A3580s1 (Lane 2), wild type 657Ba (Lane 3), 657Ba-CT4 (Lane 4), wild type Eklund 17B (Lane 5) and Eklund 17B-CT11 (Lane 6); Lambda PFG Marker (Lane M), (New England Biolabs). The position of BoNT-encoding plasmids is indicated with arrows. (A) Southern hybridization with the bont/A3 probe (Lanes 1 and 2); the bont/bvB probe (Lanes 3 and 4) and the bont/npB probe (Lanes 5 and 6); (C) Southern hybridization with the ermB probe. PFGE conditions: 6V/cm, 12° C., 1-20 s pulse time, 24 h.

FIG. 3. Confirmation of plasmid transfer from *C. botulinum* strains CDC-A3580s1, 657BaCT4-2 and Eklund 17BCT11-1 to strain LNT01. Pulsed-field gel electrophoresis of (A) SmaI digested DNA of *C. botulinum* strains LNT01 (Lane 1), CDC-A3580s1 (Lanes 2-4) and LNT01 transconjugants (pCLK-Erm) (Lanes 5-8), (B) XhoI digested DNA of *C. botulinum* strains LNT01 (Lane 1), 657BaCT4-3 (Lane 2) and LNT01 transconjugants (pCLJ-Erm) (Lanes 3-4), and (C) NarI digested DNA of *C. botulinum* strains LNT01 (Lane 1), Eklund 17BCT11-1 (Lane 2) and LNT01 transconjugants (pCLL-Erm) (Lanes 3-6), Lambda PFG Marker (Lane M), New England Biolabs. PFGE conditions for gels (A) and (B): 6V/cm, 12° C., 1-26 s pulse time, 24 h, and (C): 6V/cm, 12° C., 1-5 s, 24 h.

FIG. 4. Confirmation of plasmid pBotCDC-A3-Erm transfer from *C. botulinum* strain CDC-A3580s1 to strain LNT01 by PFGE and Southern hybridization analysis. (A) Ethidium bromide stained PFGE of *C. botulinum* DNA samples: (A) SmaI digested DNA of *C. botulinum* strain LNT01 (Lanes 1 and 7), CDC-A3 wild type (Lanes 2 and 8), CDC-A3580s1 (Lanes 3 and 9), and LNT01 transconjugants (pBotCDC-A3-Erm) (Lanes 4-6 and 10-12); (B) nondigested DNA samples (Lanes 1-6); SmaI-digested DNA samples (Lanes 7-12). Lambda PFG Marker (Lane M), New England Biolabs. The position of the pBotCDC-A3 plasmid is indicated with an arrow. Southern hybridization with: (C) the ermB probe, and (D) the bont/A3 probe. PFGE conditions: 6V/cm, 12° C., 1-26 s pulse time, 24 h.

FIG. 5. Confirmation of plasmid pCLJ-Erm transfer from *C. botulinum* strain 657BaCT4 to strain LNT01. (A) Ethidium bromide stained PFGE of *C. botulinum* strains: (A) LNT01 (Lanes 1 and 7), wild type strain 657Ba (Lanes 2 and 8); 657BaCT4 (Lanes 3 and 9) and LNT01 transconjugants (pCLJ-Erm) (Lanes 4-6 and 10-12); (B) nondigested DNA samples (Lanes 1-6); XhoI digested DNA samples (Lanes 7-12). Lambda PFG Marker (Lane M), New England Biolabs. The position of the pCLJ plasmid is indicated with an arrow. Southern hybridization with: (B) the ermB probe and (C) the bont/bvB probe. PFGE conditions: 6V/cm, 12° C., 1-26 s pulse time, 24 h.

FIG. 6. Confirmation of plasmid pCLL-Erm transfer from C. botulinum strain Eklund 17BCT11 to strain LNT01. (A-B) Ethidium bromide stained PFGE of C. botulinum strains: LNT01 (Lanes 1 and 7), wild type strain Eklund 17B (Lanes 2 and 8); Eklund 17BCT11 (Lanes 3 and 9) and LNT01 transconjugants (pCLL-Erm) (Lanes 4-6 and Lanes 10-12). (A) nondigested DNA samples (Lanes 1-6); Nan digested DNA samples (Lanes 7-12). Lambda PFG Marker (Lane M), New England Biolabs. The position of the pCLL plasmid is indicated with an arrow. Southern hybridization with: (C) the ermB probe, and (D) the bont/npB probe. PFGE conditions: 6V/cm, 12° C., 1-20 s pulse time, 24 h.

FIG. 9. Plasmid alignment of (A) pCLL (SEQ ID NO: 3; C. botulinum strain Eklund 17B); (B) pCW3 (SEQ ID NO: 27; C. perfringens strain CW92); (C) contig 1108490430999 (SEQ ID NO:29); (D) contig 1108490430283 (SEQ ID NO: 30; C. perfringens type D strain JGS1721) and (E) pCP8533etx (SEQ ID NO: 28; C. perfringens type B strain NCTC8533B4D). The alignment has five panels, one for each plasmid. The top portions of the panels are composed of segments corresponding to the boundaries of locally collinear blocks (LCBs) with lines connecting the homologous blocks in each plasmid. LCBs below a plasmid's center line are in the reverse complement orientation relative to the reference plasmid (pCLL).

FIG. 10. PFGE and Southern hybridization analysis of C. botulinum serotype A, B, Af and F strains. (A) PFGE of nondigested DNA; (B) Southern hybridizations with bont/A and (C) bont/F gene probes. Lanes: (M) Lambda PFGE ladder, (New England Biolabs), (1) ATCC 3502, (2) 5328A, (3) KyotoF, (4) Loch Maree, (5) 657Ba, (6) 14842, (7) Af84, (8) Langeland F, (9) 4852; (W) well position, (SCD) sheared chromosomal DNA.

FIG. 11. PFGE and Southern hybridization analysis of C. botulinum serotype B, Bf and F strains; (A) PFGE of nondigested DNA; (B) Southern hybridizations with bont/B and (C) bont/F gene probes. Lanes: (M) Lambda PFGE ladder (New England Biolabs), (1) OkraB, (2) 10068, (3) 17B, (4) 14842, (5) 657Ba, (6) 81E-1133, (7) 3281(32419), (8) 3281(32419), (9) Langeland F, (10) 4852.

FIG. 12. Plasmid alignment of the highly homologous virulence plasmids of proteolytic C. botulinum strains (A) Loch Maree (pCLK); (B) 675 Ba (pCLJ): (C) Bf 81E-1133 (pBot81E-1133); and (D) Okra B (pCLD).

FIG. 13. PFGE and Southern hybridization analysis of C. botulinum strain Bf 81E-1133. (A) PFGE of nondigested and digested DNA; (B) Southern hybridizations with bont/B and (C) bont/F gene probes. Lanes: (M) Lambda PFGE ladder, (New England Biolabs), (1) Nondigested DNA; Digests with (2) AatII, (3) ApaI, (4) BglI, (5) EagI, (6) MluI, (7) NaeI, (8) NarI, (9) NnuI, (10) PvuI, (11) RsnII, (12) SalI, (13) SacII, (14) SbfI, (15) SfiI, (16) SmaI, (17) XhoI.

FIG. 14. Plasmid alignment of (A) pCLK (Loch Maree) (SEQ ID NO: 1); (B) pCLJ (657) (SEQ ID NO: 2); (C) contigs 18 and 23 (Bf 81E-1133) (SEQ ID NOs: 68 and 69 respectively); and (D) pCLD (Okra) (SEQ ID NO: 4) in backbone view. Portions of LCBs in mauve colorrepresent regions of DNA conserved in all four plasmids. Homologous regions conserved between two plasmids are as follows: pCLK and pCLJ, pCLK and pBot81E-1133, pCLK and pCLD, pCLJ and pCLD, or pBot81E-1133 and pCLD. Homologous regions conserved between three plasmids are as follows: pCLK, pCLJ, and pBot81E-1133; pCLJ, pBot81E-1133, and pCLD; pCLK, pBot81E-1133, and pCLD; pCLK, pCLJ and pCLD. Regions of LCBs without color represent regions unique to each plasmid.

FIG. 15. Plasmid alignments magnified for the LCB containing the A toxin cluster of (A) pCLJ (SEQ ID NO: 2) (657); (B) contigs 18 & 23 (SEQ ID NOs: 68 and 69 respectively) (Bf 81E-1133); and (C) pCLK (SEQ ID NO: 1) (Loch Maree). The LCB containing the B toxin clusters of (D) pCLJ (657); (E) contigs 18 & 23 (Bf81E-1133); and (F) pCLD (SEQ ID NO: 4) (Okra).

FIG. 16. Plasmid alignment in backbone view magnified for the LCB containing the A toxin cluster of pCLJ (SEQ ID NO: 2) (657), contigs 18 & 23 (SEQ ID NOs: 68 and 69 respectively) (Bf81E-1133), and pCLK (SEQ ID NO: 1) (Loch Maree). Portions of LCBs in gray represent regions of DNA conserved in all three plasmids. Homologous regions conserved between two plasmids are as follows: pCLJ and pBot81E-1133, pCLJ and pCLK, or pBot81E-1133 and pCLK.

FIG. 17. (A) Schematic presentation of wild type and mutated botulinum neurotoxin genes. ClosTron insertion site is shown with a vertical arrow an (*). (B) ClosTron vector pMTL007C-E2 containing the re-targeted group II intron utilized in site specific gene inactivation. (C) Plasmids pCLK-Erm and pCLK-Erm.

DETAILED DESCRIPTION OF THE INVENTION

Figure 7:
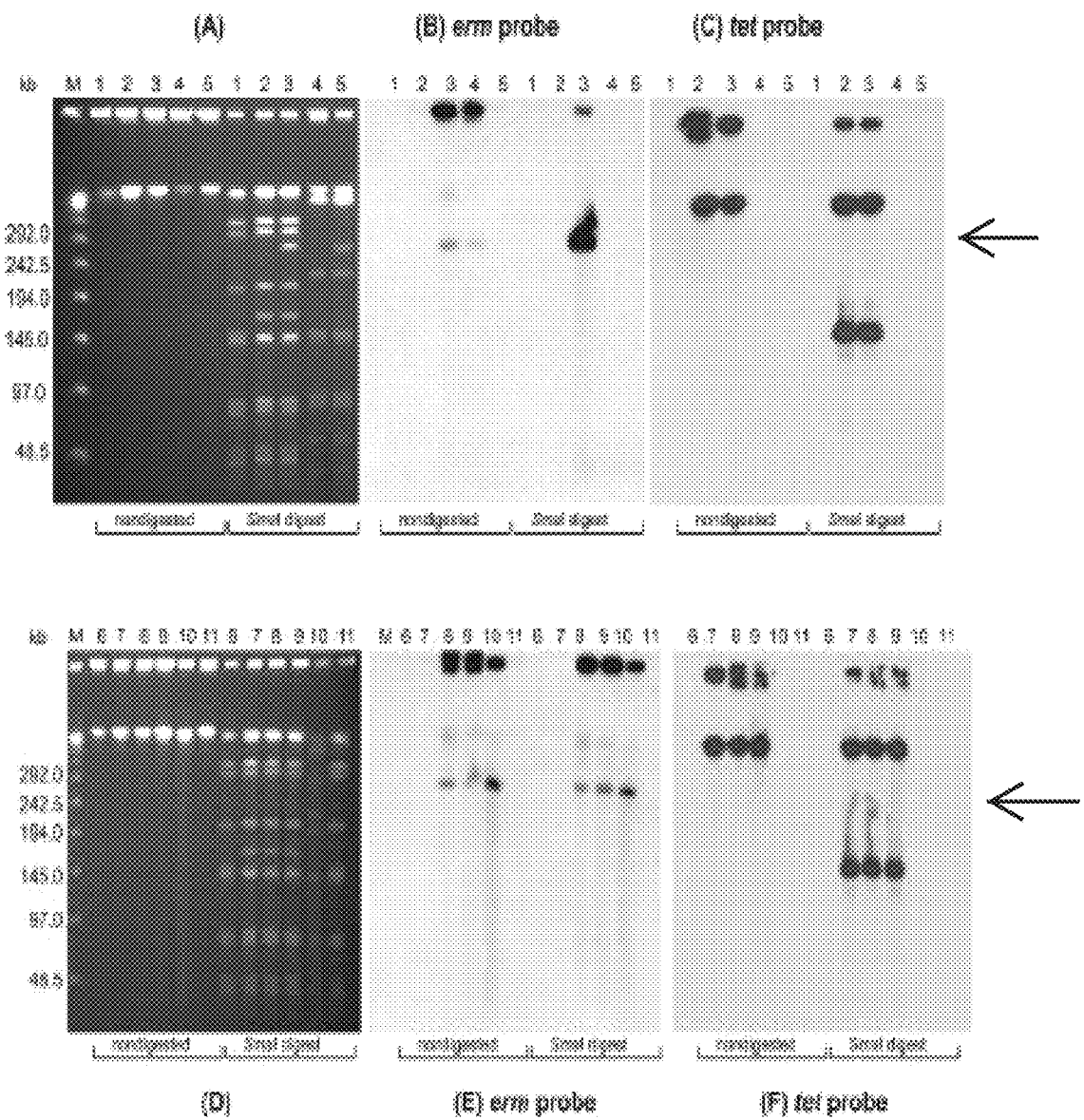
FIG. 7. Confirmation of plasmid pCLK-Erm and pCLJ-Erm transfer to C. botulinum Hall A-hyper-Tn916 mutant strain. (A) Ethidium bromide stained PFGE of C. botulinum strains: wild type Hall A-hyper (Lane 1), Hall A-hyper/Tn916 mutant (Lane 2); Hall A-hyper/Tn916/pBotCDCA3-Erm (Lane 3); CDC-A3 plasmid-cured (Lane 4); wild type CDC-A3 (Lane 5). (D) Ethidium bromide stained PFGE of C. botulinum strains: wild type Hall A-hyper (Lane 6), Hall A-hyper/Tn916 mutant (Lane 7); Hall A-hyper/Tn916/pCLJ-Erm (Lanes 8 and 9); 657Ba-CT4 (Lane 10); wild type Hall A-hyper (Lane 11). Nondigested DNA and SmaI digests were loaded on the gels as indicated below the lanes. Lambda PFG Marker (Lane M), New England Biolabs. The position of the pBotCDC-A3 and pCLJ plasmids is indicated with arrows. Southern hybridization with: (B and E) the ermB probe; and (C and F) the tet probe. PFGE conditions: 6V/cm, 12° C., 1-26 s pulse time, 24 h.

The present invention provides novel conjugatively transferable plasmids and methods of use thereof.

I. In General

In the specification and in the claims, the terms "including" and "comprising" are open-ended terms and should be interpreted to mean "including, but not limited to . . . ."

These terms encompass the more restrictive terms "consisting essentially of" and "consisting of."

As used herein and in the appended claims, the singular forms "a", "an", and "the" include plural reference unless the context clearly dictates otherwise. As well, the terms "a" (or "an"), "one or more" and "at least one" can be used interchangeably herein. It is also to be noted that the terms "comprising", "including", "characterized by" and "having" can be used interchangeably.

Unless defined otherwise, all technical and scientific terms used herein have the same meanings as commonly understood by one of ordinary skill in the art to which this invention belongs. All publications and patents specifically mentioned herein are incorporated by reference in their entirety for all purposes including describing and disclosing the chemicals, instruments, statistical analyses and methodologies which are reported in the publications which might be used in connection with the invention. All references cited in this specification are to be taken as indicative of the level of skill in the art. Nothing herein is to be construed as an admission that the invention is not entitled to antedate such disclosure by virtue of prior invention.

II. The Invention

The present invention provides novel conjugatively transferable plasmids and methods of use thereof.

A. Conjugatively Transferrable Plasmids and Methods of Synthesis Thereof.

The present invention provides novel *C. botulinum* conjugatively transmissible plasmids and methods of use thereof. By "conjugative transfer" we mean the horizontal transmission of genetic information from one bacterium to another (both uni- and multi-directionally). The genetic material transferred may be a plasmid or it may be part of a chromosome. Bacterial cells possessing a conjugative plasmid generally contain a surface structure (the sex pilus) that is involved in the coupling of donor and recipient cells, and the transfer of the genetic information. Conjugation involves contact between cells, and the transfer of genetic traits can be mediated by many plasmids. Among all natural transfer mechanisms, conjugation is the most efficient. For example, the F plasmid of *E. coli*, the pCF10 plasmid of *E. faecalis* and the pXO16 plasmid of *B. thuringiensis* are able to sustain conjugative transfer in liquid medium and exhibit transfer efficiencies of close to 100%. Thus, the conjugative process permits the very efficient delivery of plasmid DNA into a recipient bacterium.

Specifically, in one embodiment, the present invention provides novel, conjugatively transmissible plasmids and their derivatives capable of encoding a gene of interest, wherein the plasmid is capable of being transferred among and between clostridial species, thereby providing for the efficient delivery of the genes of interest into a clostridial host and the expression of said genes of interest in that host. More specifically, in one embodiment, the invention provides novel BoNT-encoding plasmids and their derivatives for conjugal transfer of these plasmid from donor *C. botulinum* strains into recipient *Clostridium* species, and used for expression of gene(s) of interest in the recipient *Clostridium* species. The novel conjugative plasmid derivatives may be comprised of replication and conjugal transfer functions derived from native conjugative plasmids found in various strains of *C. botulinum*, that can efficiently replicate in *Clostridium* species; are capable of modulating the conjugative transfer of the plasmids into recipient *Clostridium* species; and stably maintain large DNA inserts such as genes and/or gene clusters. The protein coding sequence for a gene or gene clusters of interest are operably joined to a promoter effective in *Clostridium* species; wherein the gene(s) of interest is(are) expressed in the recipient *Clostridium* species.

By "plasmid" we mean an extra-chromosomal DNA molecule separate from the chromosomal DNA. Plasmids are generally dispensable DNA molecules that are stably maintained in bacterial populations. Plasmids replicate extra-chromosomally inside the bacterium and can transfer their DNA from one cell to another by a variety of mechanisms. DNA sequences controlling extra chromosomal replication (ori) and transfer (tra) are distinct from one another; i.e., a replication sequence generally does not control plasmid transfer, or vice-versa. Replication and transfer are both complex molecular processes that make use of both plasmid- and host-encoded functions. In many cases, a plasmid is circular and double-stranded. Plasmids usually occur naturally in bacteria, but are sometimes found in eukaryotic organisms. Plasmid size varies from 1 to over 1,000 kilobase pairs (kbp). The number of identical plasmids within a single cell can range anywhere from one to even thousands under some circumstances.

The typical conjugative plasmid carries its own origin of replication (oriV) as well as an origin of transfer (oriT). It also typically includes a tra and a trb locus. When conjugation is initiated, an enzyme creates a "nick" in one plasmid DNA strand at the oriT. The enzyme may work alone or in a complex of over a dozen proteins. The transferred, or T-strand, is unwound from the plasmid and transferred into the recipient bacterium in a 5'-terminus to 3'-terminus direction. The remaining strand is replicated, either independent of conjugative action (vegetative replication, beginning at the oriV) or in concert with conjugative replication. Conjugation functions are usually plasmid encoded, but some conjugation genes can be found on the chromosome and can exhibit their activity of plasmid transfer in trans. Numerous conjugative plasmids (and transposons) are known, which can transfer associated genes within one species (narrow host range) or between many species (broad host range). Conjugation can occur between genera as widely diverse as anaerobes and aerobes.

In one embodiment, plasmids can be used from any donor *Clostridium* species. The conjugatively transferable plasmid of the present invention can be selected from any proteolytic or nonproteolytic donor *Clostridium* species. For instance, in one embodiment, the conjugatively transferable plasmid of the present invention may be selected from any *Clostridium* species. In one embodiment the plasmid is selected from *C. botulinum* serotypes A, B, C, D, E, F or G, or dual neurotoxin producing *Clostridium* strains Ba, Ab, Bf, Af and A(B). The bivalent A(B) strains contain both the BoNT/A and BoNT/B neurotoxin genes; however only BoNT/A is produced, as the BoNT/B neurotoxin gene in this strain contains a premature stop codon and thus is not expressed. In one embodiment, the plasmid pCLL (approximately 48 kb) from the nonproteolytic *C. botulinum* serotype B, strain Eklund 17B was used. In other embodiments, the plasmid may be selected from the group consisting of pBotCDC-A3, pCLJ, pBot81E-1133 and pCLD.

For instance, in on embodiment, conjugative *C. botulinum* plasmids pBotCDC-A3 (proteolytic subtype A3 strain CDC-A3, also referred to in the art as pCLK (SEQ ID NO: 1; GenBank Acc. # CP000963)), pCLJ (SEQ ID NO: 2; GenBank Acc # CP001081) and pCLL (SEQ ID NO: 3; GenBank Acc # CP001057) (tagged with antibiotic resistance markers for tracking purposes) were conjugatively transferred into other proteolytic *C. botulinum* strains, therefore these plasmids or their derivatives may be used for expression of any native or modified *botulinum* neurotoxin, its chains or subfragments or as a complex with its nontoxigenic protein components in any suitable recipient *Clostridium* species. The native toxin gene clusters of the plasmid may be replaced with any gene of interest (including other serotype or subtype native or modified botulinum neurotoxin gene clusters) for expression in the recipient *Clostridium* species.

By "gene of interest" we mean any heterologous or homologous gene capable of being expressed in the recipient *Clostridium* species. By "heterologous" we mean a nucleic acid or protein which is not native to *Clostridium* species. In one embodiment, the gene of interest may include those responsible for expressing clostridial toxins, toxin fragments, or antigenic portions thereof as well as other genes of interest known to one of skill in the art. For instance, the neurotoxin genes encoded on the plasmids pCLK (SEQ ID NO: 1) and pCLJ (SEQ ID NO: 2) are produced in very low quantities in their native hosts, *C. botulinum* strains CDC-A3 and 657Ba, respectively. Since these native BoNT-encoding plasmids pCLK (SEQ ID NO: 1) and pCLJ (SEQ ID NO: 2) are conjugative they may be transferred to a strain of *C. botulinum* that is capable of producing high quantities of neurotoxin, such as the Hall A-hyper strain. The "gene of interest" may also include fragments of the neurotoxin genes as well as other genes within the neurotoxin gene cluster that encode proteins that are and are not part of the botulinum progenitor toxin complex. By "gene of interest", we also mean any gene that is encoded by the genomes of proteolytic or nonproteolytic *C. botulinum* strain or any clostridial species that produces BoNTs including *C. baratii* and *C. butyricum*. Specifically, in one embodiment, the "gene of interest" may be selected from the group consisting of the *C. botulinum* serotypes A, B, C, D, E, F or G, *C. botulinum* strains Ba, Ab, Bf, Af or A(B), BoNT/A3 subtype gene, bont/A3 (pBotCDCA3), the bivalent BoNT/B gene, bont/bvB (pCLJ), and the nonproteolytic BoNT/B gene bont/npB (pCLL).

By "proteolytic" we mean *C. botulinum* strains which do not grow and produce toxin at temperatures below 10° C. By "nonproteolytic" we mean *C. botulinum* strains which can grow and produce toxin at 3.0° C.

The conjugatively transferable plasmid of the present invention is transferred into a recipient *Clostridium* species for expression of the gene of interest in the recipient *Clostridium* species. By "recipient *Clostridium* species" we mean a toxic or nontoxic *Clostridium* species which may be the same or different species as the *Clostridium* species of the plasmid or of the gene or interest. In one embodiment, the plasmid may be from the same *Clostridium* species as the recipient *Clostridium* species, although in other embodiments the plasmid may be from a different *Clostridium* species than the recipient *Clostridium* species. For instance, in one embodiment, transfer of plasmids from nonproteolytic *C. botulinum* to proteolytic *C. botulinum* may occur. In alternate embodiments, plasmids from proteolytic strains may be transferred to nonproteolytic strains *Clostridium* species.

By "toxic *Clostridium* species" we mean a *Clostridium* species which produces BoNT and carries their native BoNT gene on a chromosome. For instance, in one embodiment, the toxic recipient *Clostridium* species may include a *C. botulinum* strain Hall A-hyper which contains a BoNT/A1 neurotoxin gene. Plasmid transfer to this strain may also occur by contacting a BoNT encoding plasmid from a donor strain of the present invention with the recipient *Clostridium* species (i.e., Hall A-hyper) and allowing conjugation to take place, thereby yielding a toxic, recipient strain of Hall A-hyper capable of expressing the recombinant BoNT encoded by the conjugatively transferable plasmid.

By "nontoxic *Clostridium* species" we mean a *Clostridium* species which no longer produce their native BoNT because they no longer carry the BoNT gene or the BoNT gene is inactive. For instance, in one embodiment the nontoxic recipient *Clostridium* species is LNT01. *C. botulinum* strain LNT01 is a nontoxigenic, tetracycline resistant transposon Tn916 mutant of the parent *C. botulinum* subtype A1 strain 62A (subtype A1) that has lost a genome region containing the entire BoNT gene cluster (Johnson et al. 1997). However, other nontoxic recipient strains that may be used in the invention include any nontoxigenic *C. botulinum* strain. For instance, *Clostridium* strains that carry their BoNT genes on extrachromosomal plasmids or bacteriophages can be cured from these elements by several standard genetic techniques known to one of skill in the art. For instance, *C. botulinum* strain CDC-A3, which typically carries a 267 kb BoNT/A3 encoded plasmid, can be cured of its plasmid, resulting in a plasmid-less strain of CDC-A3 (CDC-A3TC5/Tn916) that is thus nontoxic. Other proteolytic *C. botulinum* strains may be constructed in this manner. Nonproteolytic *C. botulinum* strains could also be constructed in a similar fashion.

In one embodiment, the conjugatively transmissible plasmid of the present invention comprises a BoNT-encoding plasmid containing an origin of replication from the native BoNT-encoding plasmids that are effective in *Clostridium* species; and an origin of conjugative transfer from the native BoNT-encoding plasmids capable of modulating the conjugative transfer of the plasmid from a donor *Clostridium* species into a recipient *Clostridium* species, wherein the BoNT encoded by the plasmid is expressed in the recipient *Clostridium* species after transfer by the plasmid. In another embodiment, the conjugatively transmissible plasmid of the present invention comprises a BoNT-encoding plasmid containing an origin of replication from the native BoNT-encoding plasmids that are effective in *Clostridium* species; and an origin of conjugative transfer from the native BoNT-encoding plasmids capable of modulating the conjugative transfer of the plasmid from a donor *Clostridium* species into a recipient *Clostridium* species, wherein the BoNT encoded by the plasmid is expressed in the recipient *Clostridium* species after transfer by the plasmid.

By "BoNT-encoding plasmid" we mean a plasmid encoding proteolytic or nonproteolytic *Clostridium* neurotoxin genes for expressing clostridial toxins, toxin fragments, or antigenic portions thereof. In one embodiment, the BoNT-encoding plasmid is selected from the group consisting of pBotCDC-A3 (proteolytic subtype A3 strain CDC-A3, also referred to in the art as pCLK (SEQ ID NO: 1; GenBank Acc. # CP000963)), pCLJ (proteolytic subtype A4/bivalent B strain 657Ba; GenBank Acc. # CP001081), pBot81E-1133, pCLD (SEQ ID NO:4; GenBank Acc. # CP000964) and pCLL (nonproteolytic serotype B strain Eklund 17B; GenBank Acc. # CP001057).

By "origin of replication" we mean an origin of replication that is functional in a broad range of prokaryotic host cells (i.e., a normal or non-conditional origin of replication such as the ColE1 origin and its derivatives). In one embodiment the origin of replication is effective in *Clostridium* species and may be derived from native BoNT-encoding plasmids.

By "operably joined to a promoter effective in *Clostridium* species" we mean a segment of DNA that comprises sequences capable of providing both promoter and enhancer functions (i.e., the functions provided by a promoter element and an enhancer element. The availability of a *Clostridium* promoter such as is known to the art (see U.S. Pat. No. 5,955,368 to Johnson et al.) makes it possible to incorporate gene of interest into an existing plasmid wherein the resultant plasmid is transferred directly into the recipient *Clostridium* species by conjugative transfer, where the gene will be expressed and the cells of the recipient *Clostridium* species will produce protein. For example, the long terminal repeats of retroviruses contain both promoter and enhancer functions. The enhancer/promoter may be "endogenous" or "exogenous" or "heterologous." An "endogenous" enhancer/promoter is one which is naturally linked with a given gene in the genome. An "exogenous" or "heterologous" enhancer/promoter is one which is placed in juxtaposition to a gene by means of genetic manipulation (i.e., molecular biological techniques) such that transcription of that gene is directed by the linked enhancer/promoter. In one embodiment, the promoter is the native NTNH-BoNT promoter from *C. botulinum*. However, other promoter regions besides the native promoters controlling expression of the toxin and its associated proteins could be potentially introduced in the gene clusters during construction of recombinant genes. Currently, promoters such as those of the ferredoxin or thiolase genes from other clostridial species are used for gene expression in clostridia (Heap et al. 2009).

By "origin of conjugative transfer" we mean a short sequence (typically up to 500 bp) of DNA that is necessary for transfer of the plasmid from a bacterial host to recipient during bacterial conjugation. The oriT is cis-acting—it is found on the same plasmid that is being transferred, and is transferred along with the plasmid. The origin of transfer consists of three functionally-defined domains: a nicking domain, a transfer domain, and a termination domain and facilitates the transfer of plasmids across clostridial species.

By "plasmid derivative" we mean components of the novel conjugative plasmids of the present invention, including but not limited to the origin of replication, which may also be utilized in the construction of *C. botulinum*-specific shuttle vectors useful in the cloning and expression of clostridial toxins, including BoNTs and their protein complexes. For instance, any other *C. botulinum* gene of interest may be cloned into these newly constructed *C. botulinum* specific shuttle vectors. New conjugative expression vectors can be created using the replication and conjugal transfer systems from these native plasmids. This would allow one to reduce the size of these plasmids to facilitate their manipulation. The vectors currently used in our laboratory are derivatives of pJIR1457 and pJIR1456 (Bradshaw et al. 1998; U.S. Pat. No. 5,955,368), pMTL9361 (Pier et al. 2008) and modular clostridial vectors of pMTL80000 series (Heap et al, 2009). These vectors have been useful for the expression and purification of recombinant neurotoxins in a nontoxigenic strain LNT01 or other nontoxigenic *C. botulinum* host strains. Such host strains can be generated by curing the wild type strains from their BoNT-encoded plasmids or by insertionally inactivating or deleting their native BoNT genes located on the chromosome.

Accordingly, the present invention provides the first demonstration of the conjugative transfer of BoNT-encoding plasmids wherein the plasmid is from a toxic *Clostridium* species (i.e., an A3 subtype strain, an A4/bivalent B subtype strain and a nonproteolytic serotype B strain) and is effectively transferred to a non-toxic recipient *Clostridium* species (i.e., a subtype A1 strain) and the BoNT encoded by the plasmid is expressed in the recipient *Clostridium* species. Taken together, this invention provides for the efficient expression of specific genes of interest in *Clostridium* species. For instance, where the gene of interest is a specific *Clostridium* toxin, the novel plasmid and method of the present invention allows one of skill in the art to make any number of clostridial toxins, toxin fragments, or antigenic portions thereof in a clostridial host in a way that ensures abundant expression of the toxin and facilitates purification of said toxin. Furthermore, toxins with altered structures, chimeric toxins, and other toxin derivatives valuable in medicine could be synthesized in this system. Methods for conjugative transfer of the novel plasmids are described in the examples below.

B. Methods of Use.

The present invention also provides for the conjugative transfer of a gene of interest in a recipient *Clostridium* species. The method comprises conjugatively transferring a plasmid comprising an origin of replication effective in *Clostridium* species, a protein coding sequence for a gene of interest operably joined to a promoter effective in *Clostridium* species, and an origin of conjugative transfer capable of modulating the conjugative transfer of the plasmid into the recipient *Clostridium* species, wherein the gene of interest encoded by the plasmid is expressed in the recipient *Clostridium* species.

Methods of using the novel plasmid of the present invention, such as for the manufacture of therapeutic toxins or for the improved expression of pure or designer toxins or toxin fragments, are also envisioned and would be known to one of skill in the art.

III. Examples

The following examples are, of course, offered for illustrative purposes only, and are not intended to limit the scope of the present invention in any way. Indeed, various modifications of the invention in addition to those shown and described herein will become apparent to those skilled in the art from the foregoing description and the following examples and fall within the scope of the appended claims.

Materials and Methods

Bacterial Strains.

Proteolytic *C. botulinum* strains CDC-A3 (BoNT subtype A3), 657Ba (subtype A4/bivalent B), LNT01 (nontoxigenic, subtype A1), Hall A-hyper (subtype A1) and nonproteolytic *C. botulinum* serotype B strain Eklund 17B were obtained from the Johnson laboratory culture collection. *C. botulinum* strain CDC-A3 was originally obtained from the Centers for Disease Control and Prevention (CDC) (Atlanta, Ga.). MLST and PFGE analyses indicated it was genetically identical to subtype A3 strain Loch Maree (Jacobson et al. 2008). *C. botulinum* strain 657Ba was isolated from a case of infant botulism in 1976 (Hatheway et al. 1981). *C. botulinum* strain Eklund 17B was isolated from marine sediments off the coast of Washington (Eklund et al. 1967). *C. botulinum* strain LNT01 is a nontoxigenic Tn916 mutant of the parent strain 62A (subtype A1) (Lin et al. 1991; Johnson et al. 1997). Hall A-hyper is a well characterized subtype A1 strain, which produces high quantities of BoNT/A1 (Brashaw et al. 2004). *Escherichia coli* strains DH10B and CA434 were used for cloning, maintenance and conjugal transfer of the retargeted ClosTron vectors. All *C. botulinum* strains were maintained as frozen stocks at −80° C. in TPGY broth (50 g/liter trypticase peptone, 5 g/liter Bacto peptone, 4 g/liter D-glucose, 20 g/liter yeast extract, 1 g/liter cysteine-HCl, pH 7.4) containing 20% glycerol. Bacterial strains were subsequently cultured anaerobically in TPGY.

Mating Experiments.

Mating experiments were conducted on nonselective TYG (30 g/liter Bacto Tryptone, 20 g/liter yeast extract, 1 g/liter sodium thioglycollate) (4% agar) media and then spread plated onto selective TYG (1.5% agar) plates supplemented with the appropriate antibiotics. Antibiotics were used at the following concentrations: cycloserine (250 µg/ml), sulfamethoxazole (76 µg/ml), thiamphenicol (15 µg/ml), tetracycline (10 µg/ml), erythromycin (2.5 µg/ml), chloramphenicol (25 µg/ml in agar plates and 12.5 mg/ml in broth). All bacterial media components and chemicals were purchased from Becton Dickinson Microbiology Systems, Sparks, Md. and Sigma-Aldrich, St. Louis, Mo.

Plasmid Tagging Using ClosTron.

To ascertain transfer of BoNT-encoding plasmids from the donor to the recipient strain, the plasmids were tagged with an erythromycin resistance gene using the ClosTron mutagenesis system. The ClosTron mutagenesis system (Heap et al. 2004; Heap et al. 2010) was used to insertionally inactivate bont/A3, bont/bvB and bont/npB of plasmids pBotCDC-A3 (strain CDC-A3), pCLJ (strain 657Ba) and pCLL (strain Eklund 17B), respectively. The computer algorithm available through the Targetron (group II intron) Design Site was used to design the PCR primers listed in Table 1 for intron re-targeting of the selected genes bont/A3, bont/bvB and bont/npB. Primers 580|581s-IBS (SEQ ID NO: 5), 580|581s-EBS1d (SEQ ID NO:6), 381|382s-IBS (SEQ ID NO:8), 381|382s-EBS1d (SEQ ID NO:9), 420|421s-IBS (SEQ ID NO:11), 420|421s-EBS1d (SEQ ID NO:12) and EBS Universal (SEQ ID NO:14) (Table 1) were purchased from Sigma-Aldrich (St. Louis, Mo.).

TABLE 1

Oligonucleotide Primers.

| Oligonucleotide Primer | Sequence (5'-3') |
| --- | --- |
| 580\|581s-IBS (SEQ ID NO: 5) | AAAAAAGCTTATAATTATCCTTACAGATCTTACATGTGCGCCCAGATAGGGTG |
| 580\|581s-EBS1d (SEQ ID NO: 6) | CAGATTGTACAAATGTGGTGATAACAGATAAGTCTTACATTTTAACTTACCTTTCTTTGT |
| 580\|581s-EBS2 (SEQ ID NO: 7) | TGAACGCAAGTTTCTAATTTCGGTTATCTGTCGATAGAGGAAAGTGTCT |
| 381\|382s-IBS (SEQ ID NO: 8) | AAAAAAGCTTATAATTATCCTTAGTTCCCCTCGAAGTGCGCCCAGATAGGGTG |
| 381\|382s-EBS1d (SEQ ID NO: 9) | CAGATTGTACAAATGTGGTGATAACAGATAAGTCCTCGAAGATAACTTACCTTTCTTTGT |
| 381\|382s-EBS2 (SEQ ID NO: 10) | TGAACGCAAGTTTCTAATTTCGATTGGAACTCGATAGAGGAAAGTGTCT |
| 420\|421S-IBS (SEQ ID NO: 11) | AAAAAAGCTTATAATTATCCTTAACTGTCAATAAAGTGCGCCCAGATAGGGTG |
| 420\|421S-EBS1d (SEQ ID NO: 12) | CAGATTGTACAAATGTGGTGATAACAGATAAGTCAATAAATTTAACTTACCTTTCTTTGT |
| 420\|421S-EBS2 (SEQ ID NO: 13) | TGAACGCAAGTTTCTAATTTCGATTACAGTTCGATAGAGGAAAGTGTCT |
| EBS Universal (SEQ ID NO: 14) | CGAAATTAGAAACTTGCGTTCAGTAAAC |
| A3KMCT1 (SEQ ID NO: 15) | GAGATCCTGTAAATGGTGTTGATATTGC |
| A3KMCT2 (SEQ ID NO: 16) | GGTATTATCCCTCTTACACATAGCAGC |
| BVBFCT4 (SEQ ID NO: 17) | CAAACAATGATCAAGTTATTTAATAG |
| BVBRCT4 (SEQ ID NO: 18) | TCATTTAAAACTGGCCCAGG |
| NPBFCT11 (SEQ ID NO: 19) | CAAATCAAAACCATTGGGTGAAAAG |
| NPBRCT11 (SEQ ID NO: 20) | CTGGACAAAATTTCATTTGCATTATACCCC |
| AnyBF (SEQ ID NO: 21) | CAGGAGAAGTGGAGCGAAAAAAAG |

TABLE 1-continued

Oligonucleotide Primers.

| Oligonucleotide Primer | Sequence (5'-3') |
|---|---|
| AnyBR (SEQ ID NO: 22) | TGGTAAGGAATCACTAAAATAAGAAGC |
| Erm-F (SEQ ID NO: 23) | CCGATACCGTTTACGAAATTGGAACAGG |
| Erm-R (SEQ ID NO: 24) | TTATTTCCTCCCGTTAAATAATAGATAACT |
| pMTL007-R1 (SEQ ID NO: 25) | AGGGTATCCCCAGTTAGTGTTAAGTCTTGG |

A two-step PCR reaction was used to generate the 350 bp re-targeted intron. The first step included two separate PCR reactions: one containing the IBS and EBS universal primers and the other containing the EBS2 and EBS1d primers. The intron PCR template supplied in the Targetron Gene Knockout System kit (Sigma-Aldrich, St. Louis, Mo.) was used as the DNA template. Five microliters of each PCR product obtained in the first PCR reactions were combined and used as the template in a second PCR reaction containing the IBS and EBS1 d primers. PCR reactions were performed using the GeneAmp High Fidelity PCR system (Applied Biosystems, Foster City, Calif.) under the following conditions: initial hold at 94° C. for 30s; followed by 20 cycles of 15 s of denaturation at 94° C., 30s of primer annealing at 55° C., and 30s of extension at 72° C. and then a final 7 min step at 72° C. The resulting PCR products of 350 bp representing the retargeted intron were purified by gel extraction (Qiagen) and cloned into the vector pMTL007C-E2 (Heap et al. 2010) using restriction endonucleases HindIII and BsrGI by standard cloning techniques (Sambrook 2001).

Transformants containing modified ClosTron vectors were selected from E. coli strain DH10B based on chloramphenicol resistance, and plasmid DNA was isolated using a plasmid minipreparation kit (Fermentas Inc., Glen Burnie, Md.). Plasmids were analyzed by restriction analysis with HindIII and BsrGI, and the correct sequence of the intron was verified by sequencing using the primer pMTL007-R1 (SEQ ID NO: 25) (Table 1). The sequencing primer was purchased from Integrated DNA Technologies, Inc. (Coralville, Iowa). Sequencing reactions were performed using an ABI PRISM BigDye Cycle Sequencing Ready Reaction kit (Applied Biosystems, Foster City, Calif.) then purified according to manufacturer's instructions, and analyzed at the University of Wisconsin Biotechnology Center. The nucleotide sequences were aligned and analyzed with sequence analysis software VectorNTI (Invitrogen, Carlsbad, Calif.).

Plasmid DNA from one of the clones containing the correct intron sequence for targeting each BoNT gene was named pMTL007C-E2:Cbo:bont/A-580s (bont/A3), pMTL007CE2:Cbo:bont/bvB-381s (bont/bvB), and pMTL007C-E2:Cbo:bont/npB-420s (bont/npB) and was transformed into the E. coli conjugation donor strain CA434. Plasmids pMTL007C-E2:Cbo:bont/A-580s, pMTL007CE2:Cbo:bont/bvB-381s, and pMTL007C-E2:Cbo:bont/npB-420s were transferred to C. botulinum strains CDC-A3, 657Ba and Eklund 17B, respectively, by conjugation from E. coli donor strain CA434 as previously described (Heap et al. 2007).

After mating, the bacterial mixture was scraped off of the mating plates, resuspended in 1×PBS (phosphate buffered saline), serially diluted and spread plated onto TYG agar supplemented with cycloserine, sulfamethoxazole (selection of C. botulinum) and thiamphenicol (selection for the vectors). Thiamphenicol resistant colonies were purified by restreaking onto fresh TYG agar supplemented with thiamphenicol. Individual colonies were re-suspended in 1×PBS, serially diluted and plated onto TYG agar containing erythromycin to select for the presence of the spliced Erm-RAM indicating intron integration.

Erythromycin resistant colonies were re-streaked onto fresh TYG agar containing erythromycin. Erythromycin resistant clones were replica plated onto TYG containing thiamphenicol to verify plasmid loss by a thiamphenicol sensitive phenotype. Chromosomal DNA was isolated from randomly selected erythromycin resistant, thiamphenicol sensitive clones as well as from wild type C. botulinum strains using the ChargeSwitch gDNA kit (Invitrogen, Carlsbad, Calif.) following the manufacturer's instructions.

Screening of the clones was performed by PCR using the gene specific primers A3KMCT1 (SEQ ID NO: 15), A3KMCT2 (SEQ ID NO: 16) (bont/A3), BVBFCT4 (SEQ ID NO: 17), BVBRCT4 (SEQ ID NO: 18) (bont/bvB), and NPBFCT11 (SEQ ID NO: 19), NPBRCT11 (SEQ ID NO: 20) (bont/npB) (Table 1) designed to anneal to regions flanking the site of intron integration. PCR was performed with AmpliTaq High Fidelity DNA polymerase, buffer and dNTPs (Applied Biosystems, Foster City, Calif.) using a GeneAmp PCR System 9700 (Applied Biosystems) according to manufacturer's instructions. PCR primers were purchased from Integrated DNA Technologies, Inc. (Coralville, Iowa). PCR products were visualized on 1% Trisacetate-EDTA gels, stained with ethidium bromide and photographed using a Gel Imaging System (BioRad, Hercules, Calif.) with UV transillumination. PCR products were purified using a PCR purification kit (Qiagen, Valencia, Calif.) according to manufacturer's instructions.

The nucleotide sequences of the PCR fragments generated from the wild type and the transconjugant clones were determined using the same primers as for the amplification of the DNA fragments (Table 1). The nucleotide sequences were analyzed as described above.

Tn916 Mutagenesis.

C. botulinum strain Hall A-hyper was chosen for Tn916 mutagenesis to generate tetracycline-resistant strains. The genome sequence of Hall A-hyper is known (GenBank Acc: CP000727). This strain does not contain any plasmids. Tn916 mutant clones of Hall A-hyper were generated using the methods for Tn916 mutagenesis (Lin et al. 1991). This strain containing a tetracycline resistance marker was used as an alternative recipient in the bacterial mating experiments with donors CDC-A3 and 657Ba.

Mating Experiments.

Donor and recipient strains were inoculated into TPGY broth from frozen stocks and incubated anaerobically overnight. The strains were subcultured into TPGY containing 2.5 µg/ml erythromycin (donors) and 10 µg/ml tetracycline (recipients). The donors and recipients were passed again in TPGY broth supplemented with antibiotics and incubated anaerobically for 12 h. Each strain was serially diluted to approximately $10^4$ to $10^5$ CFU/ml in TPGY broth and incubated until an $OD_{600\ nm}$ of 0.6 to 0.8. Matings between donors and recipients were performed on solid nonselective 4% TYG agar. Three different donor to recipient ratios (5:1, 1:1 and 1:5) were tested. Aliquots of 1 ml or 200 µl of donor (D) and recipient (R) cells were centrifuged at 3,000×g for 5 min and resuspended in 200 µl of recipient or donor cells, respectively, and spread plated onto 4% TYG agar. The mating plates were incubated right side up for 12 h at 37° C. or 30° C., depending on the optimal growth temperature of the donor cells. Separate plates spread plated with 200 µl of donor and recipient cells were also included as controls. Sensitivity of plasmid transfer to DNaseI was tested by treating 1 µl of donor cells with DNaseI (100 µg/ml) in a buffer containing 20 mM Tris-HCl, pH 7.5, 1 mM $MgCl_2$ and 1 mM $MgSO_4$ for 37° C. for 60 minutes (Neve et al. 1984). On the nonselective agar plate 25 ml of DNaseI (10 mg/ml) and 50 µl of 50 mM $MgSO_4$ were added, spread evenly and the plates were incubated at room temperature for 60 minutes. Donor cells incubated for 60 min with DNaseI, were spun down at 3,000×g for 5 min. The supernatant was discarded and the cell pellet was re-suspended in 200 µl of the recipient strain. DNaseI (100 µg/ml) and 1 mM $MgSO_4$ were added to the cell mixture and the cells were spread plated onto the TYG agar supplemented with DNaseI and $MgSO_4$. The plates were incubated at 37° C. for 12 h.

Mating experiments were also performed by separating the donor and recipient cells with a 0.45 µm nitrocellulose membrane to determine if cell-to-cell contact is required for plasmid transfer. In these experiments 200 µl of the donor cell suspensions were spotted in the middle of the plate and spread slightly, and plates incubated until all moisture was absorbed. Then nitrocellulose membrane was placed on top of the donor cells, the plates incubated until the membrane completely adhered to the agar, followed by spreading the recipient cells in the middle of the membrane. The mating plates were incubated right side up for 12 hours at 37° C. or 30° C. The recipient cells were then scraped off the surface of the membrane using cell scrapers, the cells were resuspended in the PBS and plated on selective plates.

To assess the possible involvement of bacteriophages in plasmid transfer, donor cell cultures were passed through a 0.45 µm filter (Millipore) and mixed 1:1 with the recipient cell culture (Blaiotta et al. 2000). $CaCl_2$ (1 mM) was added and the mixture was incubated for 12 h at 37° C.

Following matings, the controls and mating mixtures were scraped off of the TYG agar plates and re-suspended in 3 ml of sterile 1×PBS, serially diluted and plated in duplicate on TYG agar supplemented with tetracycline and erythromycin for selection of the transconjugants. Serial dilutions were also spread plated onto TYG supplemented with tetracycline for enumeration of recipients and transconjugants and TYG containing erythromycin for enumeration of donors and transconjugants. The plates were incubated anaerobically for three days at 30° C. or 37° C. The plasmid transfer frequency was calculated as the number of transconjugants per number of donor cells in matings in which the number of donors was greater than the number of recipients. Transfer frequencies were calculated as the number of transconjugants per number of recipient cells when the recipient counts were greater than the donor cell counts.

Colonies resistant to both tetracycline and erythromycin were re-streaked for isolation onto fresh TYG agar supplemented with tetracycline and erythromycin and kept for further analysis.

Pulsed-Field Gel Electrophoresis.

Confirmation of plasmid transfer was performed by pulsed-field gel electrophoresis (PFGE) of nondigested and digested DNA of the transconjugant, donor and recipient strains. C. botulinum strains were inoculated into 10 ml of TPGY and incubated anaerobically at 37° C. (proteolytic strains) or 30° C. (nonproteolytic strains) to an optical density at 600 nm ($OD_{600}$) of 0.6. One milliliter of formaldehyde (Fisher Scientific, Hampton, N.H.) was added, and the cultures were placed on ice for 15 to 30 minutes to inhibit nuclease activity. PFGE plugs were prepared (Johnson et al. 2005).

To increase the visualization of plasmids, pBotCDC-A3-Erm, pCLJ-Erm and pCLL-Erm in the LNT01 transconjugant clones, restriction digests of PFGE plugs were performed using restriction endonucleases chosen to linearize each plasmid. The nucleotide sequences of each plasmid were analyzed using VectorNTI version 10.3 (Invitrogen, Carlsbad, Calif.) and a rare cutting restriction enzyme that cleaves the plasmid once was selected. Restriction enzymes SmaI, XhoI and NarI (New England Biolabs) were selected to digest the PFGE plugs of LNT01 transconjugants to assess the presence of plasmids pBotCDC-A3-Erm, pCLJ-Erm and pCLLErm, respectively. Restriction digests of the PFGE plugs were performed according to the manufacturer's instructions (New England Biolabs). Two sets of nondigested and digested DNA samples were loaded on the same gel and DNA samples were separated by PFGE in a clamped homogenous electric field system (CHEF-DRII; Bio-Rad, Hercules Calif.). After the DNA was transferred onto the nylon membrane, the filter was cut in half, and each portion contained one set of undigested and digested DNA samples. One membrane was hybridized with a neurotoxin gene specific probe, while the other with an erythromycin gene probe.

Southern Hybridizations.

Primers for generation of hybridization probes for ermB (ErmF and ErmR; SEQ ID NOs: 23 and 24 respectively); bont/A3 (A3KMCT1 and A3KMCT2; SEQ ID NOs: 15 and 16 respectively); bont/bvB and bont/npB (AnyB-F and AnyB-R) are listed in Table 1. These gene probes were generated by PCR amplification with an AmpliTaq High Fidelity DNA polymerase, buffer and dNTPs (Applied Biosystems, Foster City, Calif.) using a GeneAmp PCR System 9700 (Applied Biosystems) according to the manufacturer's instructions. The PCR products were purified from agarose gels using the Qiagen gel extraction kit (Qiagen, Valencia, Calif.), and were radioactively labeled with [α-32P] ATP using the Megaprime DNA labeling system (GE Healthcare Bio-Sciences, Piscataway, N.J.).

The DNA samples separated by PFGE were transferred to a positively charged nylon membrane (Immobilon-NY+, Millipore, Bedford, Mass.) overnight by downward capillary transfer in 0.4 M NaOH, 1.5 M NaCl. The membranes were neutralized in 2 M Tris-HCl, pH 7.0 for 15 minutes, rinsed with 2×SSC (3M NaCl, 0.3M sodium citrate) and fixed at 80° C. for 30 minutes under vacuum.

Hybridizations were performed at 42° C. for 16 h in a solution containing 5×Denhardt's Solution, 6×SSPE, 50% formamide, 0.1% SDS, 100 μg/ml herring sperm DNA (Promega, Madison, Wis.) and $^{32}$P-labeled probes at approximately 2×10$^6$ cpm/ml. All hybridization solutions and buffers were prepared according to standard protocols (Sambrook et al. 2001). After hybridizations the membranes were washed twice with 2×SSPE, 0.1% SDS for 5 min each at room temperature and twice with 0.1×SSPE, 0.1% SDS for 30 min each at 42° C. Autoradiography of the membranes was performed for 6-24 h at −70° C. using Kodak BioMax MS film with a BioMax intensifying screen (Eastman Kodak, Rochester, N.Y.).

Plasmid Alignments.

Plasmid sequence alignments were performed to determine the relatedness of the plasmid pCLL (SEQ ID NO: 3) [Acc. No. CP001057] in *C. botulinum* strain Eklund 17B to plasmids, pCP13 (SEQ ID NO: 26) [Acc. No. AP003515] of *C. perfringens* strain 13, pCW3 (SEQ ID NO: 27) [Acc No. DQ366035] of *C. perfringens* strain CW92, pCP8533etx (SEQ ID NO: 28) [Acc. No. AB444205] of *C. perfringens* strain NCTC8533B4D, and two contigs, gcontig_1108490430999 (SEQ ID NO: 29) [Acc. No. ABOO01000010.1] and gcontig_1108490430283 (SEQ ID NO: 30) [Acc. No ABOO01000017] of *C. perfringens* type D strain JGS1721. Plasmid sequence files with annotations were obtained from NCBI. Plasmid alignments were conducted using progressive alignment option of Mauve 2.3.1 (Darling et al. 2004) with the default settings. Plasmid alignments were generated using the Mauve alignment viewer, which illustrates locally collinear blocks (LCBs) as regions without rearrangements in the homologous backbone sequence. LCBs below a plasmid's center line represent the reverse complement orientation relative to the reference genome (pCP13, FIG. 8; pCLL, FIG. 9). Sequence similarity plots are displayed in the LCBs, and the height of the sequence identity plot reflects the average column entropy for the region of the respective alignment. The NCBI blastp tool was used to compare the amino acid sequences of the pCLL ORFs with ORFs in *C. perfringens* strains.

Plasmid Tagging Using ClosTron.

The neurotoxin genes, bont/A3 of plasmid pBotCDC-A3 (strain CDC-A3), bont/bvB of plasmid pCLJ (657Ba), and bont/npB of plasmid pCLL (strain Eklund 17B) were insertionally inactivated using the ClosTron mutagenesis system (Heap et al. 2007; Heap et al. 2010). The potential intron target sites within each neurotoxin gene were identified using the computer algorithm at the group II intron (TargeTron) design site provided by Sigma-Aldrich (St. Louis, Mo.). The target sites chosen for bont/A3, bont/bvB and bont/npB were between nucleotides 580 and 581, 381 and 382, and 420 and 421 on the sense strands, respectively. Each re-targeted intron was amplified by PCR and cloned into the ClosTron vector pMTL007C-E2 between restriction sites HindIII and BsrGI (Heap et al. 2010) resulting in constructs, pMTL007C-E2:Cbo:bont/A-580s, pMTL007CE2: Cbo:bont/bvB-381s, and pMTL007C-E2: Cbo:bont/npB-420s. The constructs were transferred to their respective wild-type strains CDC-A3, 657Ba and Eklund 17B by conjugation from the *E. coli* donor strain CA434.

Following matings, the cells were plated onto agar containing thiamphenicol to select for *C. botulinum* clones harboring the ClosTron vector. Thiamphenicol-resistant transconjugants of *C. botulinum* containing the ClosTron vector were then plated onto agar supplemented with erythromycin for selection of intron integrants, since the erythromycin resistance gene is restored upon integration of the group II intron (Heap et al. 2007; Heap et al. 2010). Next, erythromycin-resistant clones were screened for the loss of the intron vector by replica plating, then erythromycin-resistant and thiamphenicol-sensitive clones were selected and further analyzed by PCR to determine whether the intron had integrated into its desired target site. The gene specific PCR primers (Table 1) were designed to anneal to regions flanking the insertion site for each neurotoxin gene in order to amplify the entire insertion element.

Insertion of the re-targeted introns into either the bont/A3, bont/bvB or bont/npB genes was confirmed by PCR analysis (FIG. 1). PCR amplification of the DNA from the wild type CDCA3 strain using the bont/A3 gene specific primers A3KMCT1 (SEQ ID NO:15) and A3KMCT2 (SEQ ID NO: 16) produced a PCR product of 1,264 bp (FIG. 1, Lane 1), whereas a DNA fragment of 3,044 bp was observed in the CDCA3 transconjugant clones analyzed (FIG. 1, Lanes 2 and 3), indicating integration of the intron element (approximately 1.8 kb) into the target gene. Similarly, amplification of the 657Ba and Eklund 17B transconjugant clones (FIG. 1, Lanes 5 and 6, and Lanes 8 and 9, respectively) using bont/bvB and bont/npB gene specific primers yielded expected PCR products that exhibited an approximately 1.8 kb increase in size compared to the PCR fragments generated from the wild type 657Ba (FIG. 1, Lane 4) and Eklund 17B (FIG. 1, Lane 7). These results confirmed that the re-targeted introns containing the erythromycin resistance determinant ermB were inserted into the bont/bvB and bont/npb (FIG. 1). Furthermore, the PCR fragments amplified from the tagged BoNT-encoding plasmids were sequenced and it was confirmed that the introns had inserted correctly into the chosen target sites within the neurotoxin genes in all three plasmids.

To verify that the plasmids were tagged, pulsed-field gel electrophoresis (PFGE) of nondigested DNA samples from the wild type strains CDC-A3, 657Ba and Eklund 17B, and the clones carrying the tagged plasmids pBotCDC-A3-Erm, pCLJ-Erm and pCLL-Erm, was performed followed by Southern hybridization analyses using probes specific to ermB and the respective neurotoxin genes. Hybridization signals were observed with the plasmid bands in all strains using the neurotoxin gene probes (FIG. 2). Hybridization of the ermB probe was detected with the tagged plasmid clones but not with the wild type strains, indicating that the plasmids were successfully tagged with the ErmB-RAM. The resultant strains with their tagged plasmids CDC-A3580s1 (pBotCDC-A3-Erm), 657BaCT4 (pCLJ-Erm) and Eklund 17BCT11 (pCLL-Erm) were used as the donors in the mating experiments.

Plasmid transfer was confirmed by pulsed-field gel electrophoresis of digested DNA of transconjugant and wild type *C. botulinum* strains. *C. botulinum* strains were inoculated into 10 ml of TPGY and incubated anaerobically at 37° C. (proteolytic strains) or 30° C. (nonproteolytic strains) to an optical density at 600 nm (OD$_{600}$) of 0.6. One milliliter of formaldehyde (Fisher Scientific) was added and the cultures were placed on ice for 15 to 30 minutes to inhibit nuclease activity and PFGE plugs were prepared (Johnson et al. 2005).

To increase the visualization of virulence plasmids, pCLK-Erm, pCLJ-Erm, and pCLL-Erm in the LNT01 transconjugant clones restriction digests of PFGE plugs were performed using restriction endonucleases chosen to linearize each plasmid. The nucleotide sequences of each plasmid were analyzed using VectorNTI version 10.3 (Invitrogen, Carlsbad, Calif.) and a rare cutting restriction enzyme that cleaves the plasmid once was selected. Restriction enzymes SmaI and XhoI (New England Biolabs), were selected to digest the PFGE plugs of LNT01 transconjugants to assess the presence of plasmids pCLK-Erm and pCLJ-Erm, respectively. Plasmid pCLL is quite smaller (approximately 48 kb) than pCLK and pCLJ, and finding an enzyme that only linearizes the plasmid without over digestion of the chromosome was challenging. Based on the nucleotide sequence of pCLL, the restriction enzyme NarI was chosen. Restriction digests of the PFGE plugs was performed according to the manufacturer's instructions (New England Biolabs). The digested DNA samples were separated by PFGE in a clamped homogenous electric field system (CHEF-DRII; Bio-Rad, Hercules Calif.).

PFGE plugs were prepared for several LNT01 transconjugants that were obtained from each mating experiment to confirm the transfer of each virulence plasmid to the recipient C. botulinum strain LNT01. The PFGE plugs were digested with restriction enzymes designed to linearize each plasmid so that it could be easily visualized in the ethidium bromide stained gel. PFGE analysis of the LNT01 transconjugants from all three separate matings is shown in FIG. 1. Each bacterial strain exhibits a unique restriction banding pattern when digested with a particular restriction enzyme. Digestion of PFGE plugs of LNT01, CDC-A3580s1, 657BaCT4-2 and Eklund 17BCT11-1 all exhibit unique restriction banding patterns when digested with SmaI, XhoI or NarI (FIG. 3). The restriction banding pattern of wild type LNT01 when digested with SmaI was identical to that of the transconjugants except that the banding pattern of all transconjugant clones contained an approximately 270 kb DNA band corresponding to the presence of pCLK-Erm (FIG. 3A). The presence of pCLJ-Erm was revealed as a approximately 270 kb DNA band in the transconjugant LNT01 clones, which exhibited restriction banding patterns that were otherwise identical to LNT01 (FIG. 3B). To separate the DNA fragments in the approximately 48 kb range, the gel loaded with the DNA samples of wild-type LNT01, Eklund 17BCT11-1 and the LNT01 transconjugant clones being analyzed for the presence of pCLL-Erm, was electrophoresed with a pulse-time of 1-5 s. Under these conditions the presence of pCLL-Erm migrating to a position in the gel corresponding to its approximate linear size of approximately 48 kb in the DNA samples of the LNT01 transconjugant clones was clearly observed. This analysis confirmed the transfer of plasmid pCLL-Erm from a non-proteolytic C. botulinum serotype B strain to a proteolytic C. botulinum nontoxigenic Tn916 mutant subtype A1 strain LNT01.

Mating Experiments.

Separate mixed plate matings between each donor strain, CDCA3580s1 (pBotCDC-A3-Erm), 657BaCT4 (pCLJ-Erm), and Eklund 17BCT11 (pCLL-Erm) and recipient strains LNT01 and Hall A-hyper/Tn916 mutant were performed inside an anaerobic chamber on solid 4% agar TYG media for 12 h. Initially, strain LNT01 was used as the recipient to determine if plasmids pBotCDC-A3-Erm, pCLJ-Erm, and pCLL-Erm could be transferred to a recipient C. botulinum strain. Several mating experiments were performed to optimize the mating conditions to establish the transfer frequencies. Since similar transfer frequencies were observed when matings were performed for 12 or 24 h (data not shown); all subsequent bacterial mating experiments were incubated for 12 h. The mating pairs between proteolytic strains were performed at their optimal growth temperature of 37° C. Matings of the nonproteolytic serotype B donor strain Eklund 17BCT11 and the recipient strain LNT01 were performed at 30° C., which is the optimal growth temperature for nonproteolytic C. botulinum strains, since higher transfer frequencies were observed at this temperature (data not shown). Three different donor to recipient ratios (5:1, 1:1 and 1:5) were tested, the donor:recipient (D:R) ratio of 1:1 yielded the highest transfer frequencies. After the mating conditions were established in LNT01 the same experimental parameters were used to evaluate the transfer frequencies of C. botulinum plasmids into C. botulinum strain Hall A-hyper/Tn916 mutant.

Transconjugants were selected by plating the mating mixtures onto TYG agar supplemented with erythromycin (selection of Erm-plasmid) and tetracycline (selection of recipient strain LNT01 or Hall A-hyper/Tn916. To determine the number of donors and recipients the mating mixtures were also plated onto TYG containing either erythromycin (donors) or tetracycline (recipients). The number of donor cells and recipients varied with respect to the mating pairs (Table 2). The transfer frequency was calculated as the number of transconjugants per recipient or donor depending on which strain had the highest CFU/ml.

The transfer frequency values are displayed in Table 2. Overall, the plasmid transfer frequencies were lower than those reported for plasmids found in strains of C. perfringens (Hughes et al. 2007; Rood et al. 1978; Brynestad et al. 2001). The conjugation frequencies for pBotCDC-A3-Erm and of pCLJ-Erm increased markedly when Hall A-hyper/Tn916 was used as the recipient. Similar conjugation frequencies of plasmid pCLL from the nonproteolytic strain Eklund 17B were observed when either strain LNT01 or Hall A-hyper/Tn916 was used as recipient (Table 2). In one embodiment, D:R ratios of 1:1, 5:1 and 1:5 were tested to determine the optimum ratio for plasmid transfer. A slight increase in the conjugation frequency was observed when a ratio of 1:1 was used over the ratio of 5:1. When a D:R ratio of 1:5 was used a significant decrease in the number of transconjugants was observed. An approximately 4-log reduction in the number of CFU/ml of donors CDC-A3580s1 and 657BaCT4-2 was observed during matings with LNT01.

TABLE 2

Transfer of C. botulinum BoNT-encoding plasmids to recipient strains LNT01 and Hall A-hyper/Tn916.

| Donor | Plasmid | Recipient (LNTO1) | Recipient (Hall A-hyper/Tn916) |
|---|---|---|---|
| CDC A3580 | pBotCDC A3 Erm | $1.5 \times 10^{-8} \pm 1.2 \times 10^{-8a}$ | $1.8 \times 10^{-6} \pm 9.4 \times 10^{-7b}$ |
| 657Ba-CT4 | pCLJ-Erm | $1.4 \times 10^{-6} \pm 1.1 \times 10^{-6a}$ | $1.7 \times 10^{-5} \pm 1.2 \times 10^{-5a}$ |
| Eklund 17BCT11 | pCLL-Erm | $1.5 \times 10^{-7} \pm 1.4 \times 10^{-7a}$ | $4.5 \times 10^{-7} \pm 2.8 \times 10^{-7a}$ |

Transfer frequencies were calculated as the number of tranconjugants per [a]recipient or [b]donor and are reported as the averages of at least three replicate experiments.

Pre-incubation of the donor cells with DNaseI, by combined addition of DNaseI to the agar medium and to the mating mixtures did not inhibit plasmid transfer, and the transfer frequencies were similar to that of matings in which DNaseI was not added. Furthermore, no transductants were obtained in matings performed with the filtered culture supernatants of each donor strain and the whole cell culture of the recipient strain LNT01. Importantly, no transconjugants were obtained when matings were performed in which the donors and recipients were separated by a 0.45 μm nitrocellulose membrane.

Confirmation of BoNT-Encoding Plasmid Transfer.

PFGE was performed using nondigested samples and samples digested with restriction enzymes designed to linearize each BoNTencoding plasmid. PFGE analysis of digested samples allowed us to use the unique restriction banding patterns of the strains as a genetic screen to visually determine whether the plasmids were transferred to the recipient strains. PFGE analyses of the recipient LNT01, donor strains and LNT01 transconjugants from three separate matings are shown in FIGS. 4-6. LNT01 (recipient), wild type and plasmid-tagged donor strains, and three clones of each transconjugants all exhibited unique restriction banding patterns when digested with SmaI, XhoI or NarI PFGE followed by Southern hybridization analyses using the ermB probe (intron probe) and the appropriate neurotoxin gene probes showed that the tagged plasmids were transferred to the recipient strains (FIGS. 4-6).

Transfer of pBotCDC-A3-Erm from CDC-A3 (donor) to LNT01 (recipient) is shown in FIG. 4. When PFGE is performed on nondigested C. botulinum DNA samples most of the DNA remains trapped in the wells because large circular DNA molecules that are nicked or enzymatically relaxed fail to enter the gel matrix (Beverley 1988). Linear forms of plasmids are able to migrate through the gel to a position which corresponds to their linear size relative to a reference marker (Beverley 1988). In addition, a small portion of sheared chromosomal DNA migrating a short distance from the well position is frequently observed in PFGE analysis of nondigested clostridial DNA (Marshall et al. 2007). The DNA restriction banding pattern of the wild type strain LNT01 (FIG. 4, lane 7A) digested with SmaI was identical to that of the transconjugants (FIG. 4, lanes 10-12A), except that the banding pattern of all transconjugants clones contained an additional band of approximately 270 kb. This band corresponds by size to the plasmid, pCDC-A3-Erm in the donor strain (FIG. 4A, lanes 2, 3 and 8, 9). This approximately 270 kb band was observed in digested (FIG. 4, lanes 10-12) and nondigested (FIG. 4, lanes 4-6) samples of the transconjugants hybridized with both bont/A3 (FIG. 4C, lanes 4-6, 10-12) and ermB probes (FIG. 4B, lanes 4-6, 10-12). These results confirmed the transfer of the tagged plasmid containing the intron interrupted bont/A3 gene. The same plasmid band in the donor strains hybridized with the bont/A3 probe (FIG. 4C, lanes 2, 3, 8, 9), but only the tagged donor hybridized with the ermB probe (FIG. 4B, lanes 3 and 9). No hybridization signals were detected with either probe in the recipient strain LNT01. PFGE of digested samples of the transconjugant and donor strains (FIG. 4A, lanes 8-12) showed an increase in the intensity of the approximately 270 kb band in the ethidium bromide stained gel as well as produced stronger hybridization signals with the neurotoxin gene (FIG. 4C, lanes 8-12) and ermB (FIG. 4B, lanes 9-12) probes, while the hybridization signals at the well positions decreased. This indicated that the plasmid was linearized by the restriction enzyme and migrated into the gel.

Similarly, transfer of the approximately 270 kb plasmid, pCLJ-Erm, from the donor strain 657BaCT4 to LNT01 (FIG. 5), and the approximately 48 kb plasmid, pCLL from Eklund 17BCT11 to LNT01 was confirmed (FIG. 6). Furthermore, transfer of plasmids pBotCDC-A3-Erm, and pCLJ-Erm to Hall A-hyper/Tn916 was also confirmed by PFGE and Southern hybridization analyses (FIG. 7).

Plasmid Alignments.

The genome alignment tool Mauve (Darling et al. 2004) was used to generate global alignments of C. botulinum plasmid pCLL (SEQ ID NO:3) (strain Eklund 17B) and C. perfringens plasmid pCP13 (SEQ ID NO: 26) (strain 13). Alignment of plasmids pCLL and pCP13 (FIG. 8) revealed 16 locally collinear blocks (LCBs) A3 probe (FIG. 8C: lanes 2, 3, 8, 9), with at least some portion of them found in pCP13. The LCB shown (FIG. 8) encompassed a region of 11ORFs which exhibited the highest degree of sequence homology with similar ORFs found on plasmid pCP13. The Mauve program was also used to generate global alignments of pCLL and C. perfringens plasmids pCW3 (SEQ ID NO: 27), pCP8533etx (SEQ ID NO: 28), and two contigs of C. perfringens type D strain JGS1721 (gcontig_1108490430283 [SEQ ID NO: 30] and gcontig_1108490430999 [SEQ ID NO: 29]). The alignments revealed several locally collinear blocks (LCBs) with at least some portion of them found in the C. perfringens plasmids (FIG. 9). Two neighboring LCBs shown were of particular interest because they shared homology with the conjugative C. perfringens plasmids. The region that contained the tcp locus common to C. perfringens conjugative plasmids is represented by the LCB (FIG. 9). The corresponding LCB observed in pCLL shares some sequence homology with this region as indicated in FIG. 9, however this region is truncated. The LCB of plasmid pCLL contains a gene that encodes for a putative type IV secretion system protein VirD4 (pCLL_0005). Comparison of homologous ORFs of pCLL and C. perfringens plasmids is presented in Table 3.

TABLE 3

Comparison of predicted ORFs of pCLL with plasmids of C. perfringens.

| pCLL Locus | Putative Function of pCLL gene product | Funciton of closest C. perfringens relative of gene product, strain and/or identity | Size (aa) | Coding Sequence position |
|---|---|---|---|---|
| pCLL_0004 | Hypothetical protein | Hypothetical protein, C. perfringens pCP13, PCP53, and conserved hypothetical, C. perfringens E str. JGS1987, CPC_A0335, 53/78 (67%) | 78 | 717-953 |
| pCLL_0005 | VirD4 component | TraG/TraD family, C. perfringens D str. JGS1721, CJD_A0258, 383/747 (51%) | 739 | 1017-3236 |
| pCLL_0006 | Hypothetical protein | Putative membrane protein, C. perfringens C str. JGS1495, CPC_A0332, 162/353 (45%), hypothetical protein C. perfringens pCP13, PCP50, 162/353 (45%) | 711 | 3241-5376 |

TABLE 3-continued

Comparison of predicted ORFs of pCLL with plasmids of *C. perfringens*.

| pCLL Locus | Putative Function of pCLL gene product | Funciton of closest *C. perfringens* relative of gene product, strain and/or identity | Size (aa) | Coding Sequence position |
|---|---|---|---|---|
| pCLL_0007 | Hypothetical protein | Hypothetical protein, *C. perfringens* pCP13, PCP49, 47/87 (54%) | 91 | 5377-5652 |
| pCLL_0008 | Hypothetical protein | Hypothetical protein, *C. perfringens* pCP13, PCP48, 66/124 (53%) | 138 | 5764-6402 |
| pCLL_0009 | Hypothetical protein | Conserved hypothetical, *C. perfringens* C str. JGS1495, CPC_A0328, 406/627 (64%) | 637 | 6458-8371 |
| pCLL_0010 | Hypothetical protein | Hypothetical protein, *C. perfringens* pCP13, PCP45, 55/161 (34%) | 167 | 8373-9053 |
| pCLL_0011 | Probable cell wall-binding protein | Probable cell wall-binding protein, *C. perfringens* E str. JGS1987, AC3_A0050, 224/370 (60%), TcpG, *C. perfringens* C str. JGS1495, CPC_A0146, 83/134 (61%) | 389 | 9114-10283 |
| pCLL_0012 | Hypothetical protein | Conserved hypothetical protein, *C. perfringens* D str. JGS1721, CJD_1944, 106/267 (39%) | 270 | 10302-11114 |
| pCLL_0013 | Hypothetical protein | Conserved hypothetical protein, *C. perfringens* C str. JGS1495, CPC_A0323, 42/82 (51%) | 91 | 11397-11672 |
| pCLL_0014 | Hypothetical protein | Conserved hypothetical protein, *C. perfringens* D str. JGS1721, CJD_A0233, 48/123 (39%) | 136 | 11678-12088 |
| pCLL_0015 | Hypothetical protein | Conserved hypothetical protein, *C. perfringens* C str. JGS1495, CPC_A0321, 200/377 (53%) | 379 | 12102-13241 |
| pCLL_0016 | Hypothetical protein | Conserved hypothetical protein, *C. perfringens* D str. JGS1721, CJD_A0227, 55/116 (47%) | 365 | 13267-14388 |
| pCLL_0017 | Conserved hypothetical protein | Hypothetical protein, *C. perfringens* str. 13 pCP13, PCP34, 31/74 (41%) | 171 | 14453-14968 |
| pCLL_0040 | Resolvase/recombinase | Resolvase/Recombinase, *C. perfringens* D str. JGS 1721, CJD_1891, 78/210 (37%) | 210 | 33462-34094 |
| pCLL_0042 | Site-specific recombinase resolvase family | DNA-invertase, *C. perfringens* CPE str. F4969, AC5_A0225, 80/191 (41%) | 181 | 34265-34810 |
| pCLL_0045 | Replication protein | Replication protein, *C. perfringens* B str. ATCC 3626, AC1_A0161, 164/388 (42%) | 446 | 35980-37320 |
| pCLL_0047 | Putative ATPase | Putative ATPase, *C. perfringens* E str. JGS1987, AC3_0198, 145/302 (48%) | 297 | 38545-39438 |
| pCLL_0048 | Hypothetical protein | Hypothetical protein, *C. perfringens* E str. JGS1987, AC3_0197, 21/41 (51%) | 119 | 37431-39790 |
| pCLL_0051 | Putative LexA repressor | LexA repressor, *C. perfringens* B str. ATCC 3626, AC1_A0290, 34/78 (43%) | 235 | 40570-41277 |
| pCLL_0053 | Hypothetical protein | Conserved hypothetical protein, *C. perfringens* B str. ATCC 3626 AC1_A0334, 33/105 (31%) | 120 | 41747-42109 |
| pCLL_0056 | Cell wall binding repeat domain protein | Cell wall binding repeat domain protein, *C. perfringens* D str. JGS1721, CJD_0682, 83/183 (45%) | 152 | 42953-47533 |

The numbering for the coding sequence position starts at position 1. There are total of 56 ORFs in the pCLL plasmid, but only those that showed homology with *C. perfringens* ORFs are listed in Table 3. Any protein sequences for these ORFs are available from GenBank (http://www.ncbi.nlm-.nih.gov.ezproxy/nuccore/CP001057).

Results.

The present invention provides BoNT-encoding plasmids capable of conjugatively transferring genetic information of interest among other *Clostridium* species (where the plasmid is from the same *Clostridium* species, as well as where the plasmid is from different *Clostridium* species). Mating experiments were conducted between *Clostridium* species harboring a BoNT-encoding plasmid and a nontoxigenic *C. botulinum* strain LNT01 as the recipient. Plasmids from *C. botulinum* strains CDC-A3 and 657Ba, plasmids pBotCDC-A3 (267 kb) and pCLJ (270 kb), respectively, were selected to represent proteolytic *Clostridium* species. Plasmid pCLL (48 kb) from *C. botulinum* serotype B, strain Eklund 17B was selected as a representative of nonproteolytic *Clostridium* species. The recipient strain LNT01 was selected because it is nontoxigenic, and it contains a tetracycline resistance marker due to presence of the transposon Tn916 on the genome.

To ascertain transfer of the plasmids from the donor *Clostridium* species to the recipient *Clostridium* species, the plasmids were tagged with an antibiotic resistant gene, wherein the antibiotic resistant gene confers resistance to antibiotics selected from the group consisting of erythromycin, tetracycline, chloramphenicol or thiamphenicol. While any antibiotic resistant gene may be used, the present examples used the erythromycin resistance gene via the ClosTron mutagenesis system. The antibiotic resistance gene inserted on the plasmids is required only to track the plasmid transfer from the donor *Clostridium* species to the recipient *Clostridium* species, and is not required for plasmid maintenance in the recipient *Clostridium* species. The example above demonstrates that positive selection of transconjugants was facilitated by the presence of the tetracycline resistance determinant in combination with erythromycin resistance provided by the tagged plasmids.

Discussion.

Early studies attempting to demonstrate plasmid-associated BoNT genes were unsuccessful, except for discovery of the plasmid-borne BoNT/G gene (Zhou et al. 1995). The recent finding of plasmids in *C. botulinum* serotypes A and B housing BoNT/A, BoNT/B or both BoNT/A and BoNT/B genes (Marshall et al. 2007; Smith et al. 2007) prompted surveys of serotype B strains (Franciosa et al. 2009; Umeda et al. 2009) and dual neurotoxin *C. botulinum* strains producing subtypes Bf, Af and Ab BoNTs (Marshall 2009; Franciosa et al. 2009). These studies have invigorated interest in the field of plasmid biology in *C. botulinum*. The present invention demonstrates that plasmids encoding BoNTs can be transferred to other *Clostridium* species.

Specifically, the present invention therefore provides BoNT-encoding plasmids (such as pBotCDC-A3 and pCLJ from two proteolytic *Clostridium* species), and pCLL from a nonproteolytic *Clostridium* species, to other proteolytic *Clostridium* species, providing a novel conjugatively transferable plasmid capable of transferring BoNT-encoding plasmids to other recipient *Clostridium* species. Transductants were not obtained when the recipient cells were incubated with filtered donor culture supernatants, demonstrating that bacteriophages were not involved in BoNT gene transfer. Furthermore, since BoNT gene transfer was not inhibited by the addition of DNaseI, and no transconjugants were obtained during matings in which the donor and recipient cells were separated by a 0.45 μm filter, cell-to-cell contact is required for the transfer of these plasmids (demonstrating that plasmid transfer across *Clostridium* species is likely due to conjugation or a conjugation-like mechanism rather than by transformation).

Previously, *C. perfringens* was the only *Clostridium* described to harbor plasmids capable of intraspecies conjugative transfer (Hughes et al. 2007; Rood et al. 1978; Byrnestad et al. 2001; Rood et al. 2004; Bannam et al. 2006). Here, conjugative transfer of plasmid pCLL from the nonproteolytic *C. botulinum* serotype B strain Eklund 17B to a proteolytic *C. botulinum* strain supports interspecies transfer since proteolytic and nonproteolytic groups have long been considered to comprise different *Clostridium* species based on different genomic, genotypic and phenotypic characteristics (Carter et al. 2009; Peck et al. 2009).

Intraspecies conjugal transfer of plasmids in *C. perfringens* has been reported to be a highly efficient process with conjugation frequencies of $10^{-1}$ to $10^{-2}$ transconjugants per donor (Hughes et al. 2007; Rood et al. 1978; Byrnestad et al. 2001). Conversely, the conjugation frequencies for the *C. botulinum* plasmids tested in this study were much lower ranging from $10^{-5}$ to $10^{-8}$ (Table 2). *C. botulinum* strain LNT01 was initially selected as a recipient, since it is nontoxigenic and contained the tetracycline resistance marker for positive selection of transconjugants. Although each of the plasmids was successfully transferred to LNT01, we observed a decrease in the number of donor cells during matings. For example, an approximately 4-log reduction in the number of CFU/ml of donors CDC-A3580s1 and 657BaCT4-2 was observed during matings with LNT01. A possible explanation may be that strain LNT01 produces a bacteriocin (unpublished data) that could inhibit the growth or kill the donor cells. *C. perfringens* strain F4969 was also reported to produce a bacteriocin which interfered with the transfer of plasmid pMRS4969 from this strain to the recipient *C. perfringens* strain because the bacteriocin greatly inhibited or killed the recipient cells (Byrnestad et al. 2001).

Interestingly, only a 1-2 log reduction of donor (CFU/ml) was observed when the nonproteolytic *C. botulinum* strain Eklund 17BCT11 was used as the donor. To further investigate if a plasmid-endoded bacteriocin affected transfer efficiencies, another *C. botulinum* strain (Hall A-hyper/Tn916) that does not contain any plasmids nor a plasmid encoded-bacteriocin similar to those identified in *C. botulinum* strains ATCC 3502 (Acc. No. AM412318) (Sebaihia et al. 2007) and 213B (Dineen et al. 2000), was tested as a recipient. The plasmid transfer frequency of pCLJ and pBotCDC-A3 into Hall A-hyper/Tn916 increased by at least a log compared to that of LNT01 as a recipient while the transfer frequency of pCLL from the nonproteolytic strain Eklund 17B was similar when both recipients were tested (Table 2).

*C. botulinum* strain CDC-A3 is identical to strain Loch-Maree based on MLST (Jacobson et al. 2008) and PFGE analyses (Marshall 2009), and it is highly likely that the plasmids are identical in both strains. The nucleotide sequences of pCLK (SEQ ID NO: 1) (strain Loch Maree, A3), pCLJ (SEQ ID NO: 2) (strain 657Ba, A4) and pCLL (SEQ ID NO: 3) (strain 17B) genome sequences have been deposited in GenBank (Hughes et al. 2007). Although plasmids pCLK and pCLJ share significant sequence homology, the sequence of plasmid pCLL is unrelated to pCLJ and pCLK (Marshall 2009; Hill et al. 2009). Detailed sequence analysis of the botulinum gene clusters of plasmids pCLK and pCLJ have been performed, but little emphasis has been given to the functions of other plasmid genes (Smith et al. 2007). Most of the ORFs of these plasmids are described as putatively encoding hypothetical or conserved hypothetical proteins. The mechanism for plasmid replication is unknown, because gene homologues involved in typical rolling-circle or theta replication have not been identified on these plasmids (Smith et al. 2007). Similarly, the mechanism of plasmid transfer is also unknown, but genes homologous in plasmids pCLK and pCLJ that may be involved in plasmid transfer are suggested by the genome annotations. For example, TraK analogs (CLK_A0294; CLJ_A0213) and TraG/D (CLK_A0293; CLJ_A0212) flanked by hypothetical ORFs, as well as genes that encode for putative type II and type IV secretion system proteins, such as pili, have been described.

Figure 8:
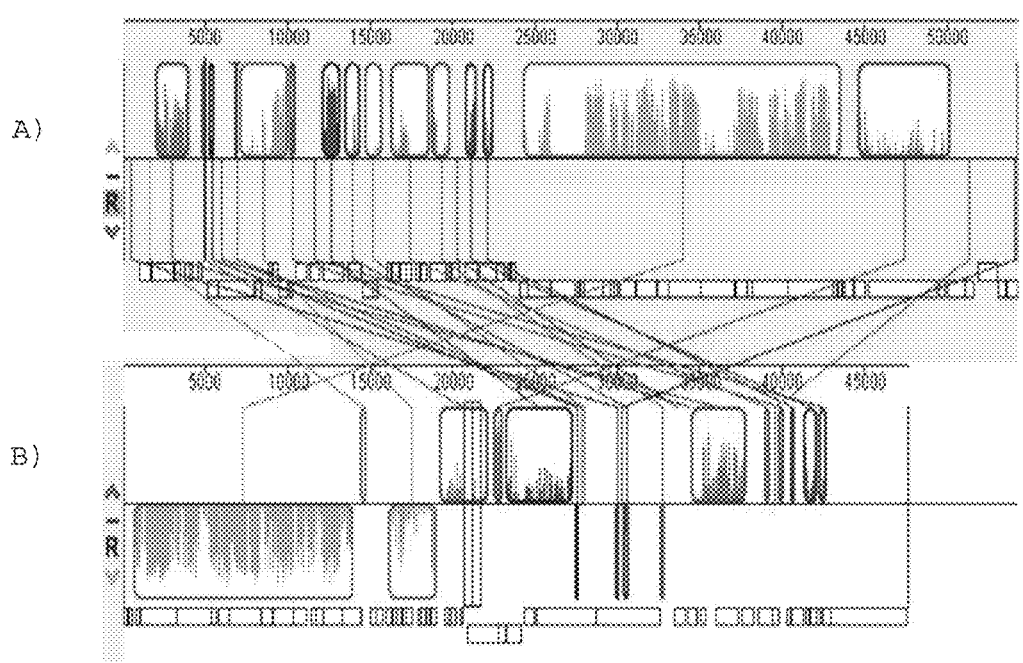
FIG. 8. Plasmid alignment of (A) pCP13 (C. perfringens strain 13) and (B) pCLL (C. botulinum strain Eklund 17B). The alignment has two panels, one for each complete plasmid: pCP13 [top position] and pCLL [bottom position]. The top portions of the panels are composed of colored segments corresponding to the boundaries of locally collinear blocks (LCBs) with lines connecting the homologous blocks in each plasmid. LCBs below a plasmid's centerline are in the reverse complement orientation relative to the reference plasmid (pCP13). The lower portion of the panels represent the predicted open reading frames (ORFs) for the corresponding segments of double stranded DNA with ORFs on top representing top strand and below (bottom strand).

Plasmid pCLL of nonproteolytic *C. botulinum* serotype B strain Eklund 17B is approximately 48 kb in size and contains 56 putative ORFs. As mentioned above, pCLL does not exhibit homology with sequenced plasmids in proteolytic *C. botulinum* strains. Therefore, homology searches of pCLL were performed with genome sequences of other clostridial species. Initially, a nucleotide sequence alignment of pCLL with pCP13 of *C. perfringens* strain 13 was performed using Mauve. Surprisingly, this analysis identified regions of homology between pCLL and pCP13, which are graphically displayed as colored locally collinear blocks (LCBs) (FIG. 8). More detailed BLAST analyses revealed eleven ORFs within the gold-colored LCB (CLL_0004 to CLL_0017) with a range of identity from 34 to 67% with ORFs of plasmid pCP13 (Table 3). Considering that pCP13 is not a conjugative plasmid, further sequence analyses were performed between pCLL and completed sequences of conjugative *C. perfringens* plasmids and draft genome sequences of several *C. perfringens* strains.

Interestingly, two conjugative *C. perfringens* plasmids pCW3 (SEQ ID NO: 27) and pCP8533etx (SEQ ID NO: 28) as well as two contigs representing potential plasmids in a type D strain were identified by the Mauve program to contain regions homologous to pCLL (SEQ ID NO:3) (FIG. 9). The Mauve program revealed two LCBs, which represented regions of pCLL homologous to the *C. perfringens* nucleotide sequences. The LCB encompassed the tcp (Transfer of *Clostridium* Plasmids) locus common to conjugative *C. perfringens* plasmids (Bannam et al. 2006). Although plasmid pCLL does not seem to contain the entire tcp locus, it does carry genes that encode for proteins that exhibit 61% (CLL_0011) identity to TcpG (CPC_A0146 of *C. perfringens* C strain JGS1495) (Bannam et al. 2006). The ORF pCLL_0005 (a putative VirD4 homolog) in the LCB showed 51% identity to CJD_A0258 (a putative VirD4 component) of *C. perfringens* type D strain JGS 1721. Further BLAST analyses revealed that *C. perfringens* type D strain JGS 1721 contained several ORFs with identities ranging from 37%-51% with ORFs of pCLL (Table 3). *C. perfringens* type D strains carry several plasmids ranging in size from approximately 48 to 110 kb. These strains produce both alpha-toxin (plc gene) and epsilon-toxin (etx gene). The epsilon toxin is ranked third in potency following BoNTs and tetanus neurotoxin (Smedley et al. 2005). *C. perfringens* type D strains that produce alpha-toxin and epsilontoxins, but not the enterotoxin (cpe gene) or the beta 2 toxin (cpb2 gene) have been reported to carry the etx gene on a plasmid of 48 kb (Sayeed et al. 2007). The etx plasmid in *C. perfringens* type D strain JGS 1721 also contains the tcp locus (Sayeed et al. 2007). The draft genome sequence of *C. perfringens* strain JGS 1721 consists of 221 contigs. The pCLL ORFs shared homology with 16 and 8 ORFs within two of these contigs, gcontig_1108490430999 (SEQ ID NO: 29) and gcontig_1108490430283 (SEQ ID NO:30), respectively. Interestingly, gcontig_1108490430283 carries the genes that encode for etx and the tcp locus.

Overall, homology searches revealed that BoNT-encoding plasmid pCLL of the nonproteolytic *C. botulinum* strain exhibited some degree of homology with both conjugative and nonconjugative plasmids in *C. perfringens*. The presence of BoNT genes on conjugative plasmids in both proteolytic and nonproteolytic strains of *C. botulinum* is highly significant and could facilitate the dissemination of neurotoxin genes to other species of clostridia. It is conceivable that BoNT-encoding plasmids were involved in the transfer of BoNT/E and BoNT/F genes to *C. butyricum* and *C. baratii*.

In summary, the present invention provides for the first time the novel conjugative transfer of proteolytic and nonproteolytic *C. botulinum* plasmids encoding BoNT genes to other proteolytic *C. botulinum* strains. Since BoNT is the most potent toxin known, BoNT gene transfer to other bacteria could lead to the generation of new pathogens of high impact, such as emergence of new BoNT-forming clostridia with resistant phenotypes, and strains with higher spore heat resistance than *C. botulinum*. The finding that pCLL of the nonproteolytic *C. botulinum* serotype B strain contains gene regions that are homologous with plasmids in *C. perfringens* is intriguing and illustrates the potential transfer of plasmids to other clostridial species.

Identification of Botulinum Neurotoxin Genes on a Plasmid in *C. Botulinum* Bf Strains.

Bacterial Strains.

The *C. botulinum* strains were obtained from the Johnson laboratory culture library and are listed in Table 4.

TABLE 4

| BoNT genes on plasmids in *C. botulinum* strains. | | | | | |
|---|---|---|---|---|---|
| | Neurotoxin gene | | Virulence plasmid | | |
| Strain | Serotype | Location | Name | Size (kb) | Source or reference[a] |
| 81E-1133 | B | Plasmid | pBot81E-1133 | ~190 | This study |
| | F | Plasmid | pBot81E-1133 | ~190 | This study |
| 3281(32419) | B | Plasmid | pBot3281 | ~260 | This study |
| | F | Plasmid | pBot3281 | ~260 | This study |
| 84 | A2 | Chromosome | | | This study |
| | F | Chromosome | | | This study |
| ATCC 3502 | A1 | Chromosome | | | Sebaihia |
| 5328A | A1 | Chromosome | | | Mars. Raphael |
| KyotoF | A2 | Chromosome | | | Mars.&Smit |
| Loch Maree | A3 | Plasmid | pCLK | 266,785 | Mars&SMit |
| 657Ba | A4 | Plasmid | pCLJ | 270,346 | Mars.&Smit |
| | B | Plasmid | pCLJ | 270,346 | Mars and Smith |
| OkraB | B | Plasmid | pCLD | 148,780 | Smith et al. |
| 14842 | B | Plasmid | pBot14842 | ~260 | This study |
| 10068 | B | Plasmid | pBot10068 | ~48 | This study |
| 17B | B | Plasmid | pCLL | 47,642 | GenBank (CP001056) |
| Alask E | E | Chromosome | | | GenBank (CP001078) |

TABLE 4-continued

BoNT genes on plasmids in *C. botulinum* strains.

| Strain | Serotype | Neurotoxin gene Location | Virulence plasmid Name | Size (kb) | Source or reference[a] |
|---|---|---|---|---|---|
| Langeland F | F | Chromosome | | | GenBank (CP000728) |
| 4852 | F | Chromosome | | | This study |

[a]Source or reference for determination of plasmid or chromosomally encoded neurotoxin genes BoNT Strain Af 84 is a soil sample isolate from the Mendoza province in Argentina (Gimenez 1978), and strains Bf 81E-1133 and Bf 3281(32419) were isolated from separate cases of infant botulism in New Mexico, USA (Hatheway 1987). *C. botulinum* strains representing four BoNT/A subtypes (A1-A4) and proteolytic and nonproteolytic serotypes B and F were included in the PFGE and Southern blot analyses for comparison with the Bf and Af subtype strains. All strains were maintained as frozen stocks at −80° C. in TPGY broth (50 g/liter trypticase peptone, 5 g/liter Bacto peptone, 4 g/liter D-glucose, 20 g/liter yeast extract, 1 g/liter cysteine-HCl, pH 7.4) supplemented with 40% glycerol. Bacterial strains were subsequently cultured anaerobically in TPGY broth sparged with nitrogen gas prior to autoclaving.

The prevalence of virulence plasmids appears to be highest among proteolytic and nonproteolytic serotype B strains (Franciosa et al. 2009). In agreement with other reports, plasmids of nonproteolytic serotype B strains are significantly smaller than the virulence plasmids found in proteolytic serotype B and bivalent strains analyzed (FIG. 10A). Plasmids of approximately 48 kb were consistently observed in several nonproteolytic serotype B strains (FIG. 10A; unpublished data), whereas the plasmids in bivalent and proteolytic B strains ranged in size from approximately 148 kb to 270 kb (FIG. 10A). Whole genome sequencing of the nonproteolytic serotype B strain 17 B has been completed (GenBank Acc. No. CP001056) and the presence of virulence plasmid pCLL (47.6 kb) has been confirmed in this study and by other researchers (Franciosa et al. 2009). The new virulence plasmid, pBot10068 identified in the nonproteolytic serotype B strain 10068, was similar in size (approximately 48 kb) to plasmid pCLL (FIG. 10). No other plasmids of nonproteolytic serotype B strains have been sequenced, but it is likely that they are highly homologous, since virulence plasmids of consistent size (approximately 48 kb) are common among nonproteolytic serotype B strains (unpublished data; Franciosa et al. 2009).

Attempts to align pCLL (SEQ ID NO: 3) (17B) with pCLD (SEQ ID NO: 4) (Okra B) using the MAUVE software were not successful, indicating that the plasmids are not sufficiently related. The only homologous regions identified between these two plasmids using the comparison tools at the Pathema-*Clostridium* website were the type B neurotoxin gene clusters. The physiological and metabolic properties of proteolytic and nonproteolytic *C. botulinum* strains vary. Thus, it is not surprising that these strains carry plasmids that differ significantly in size as well as in gene content. The relatedness of plasmids found in nonproteolytic *C. botulinum* strains to the plasmids in other toxigenic clostridia remains to be determined.

Pulsed-Field Gel Electrophoresis.

Bacterial strains were inoculated into 10 ml of TPGY and incubated anaerobically at 37° C. to an optical density at 600 nm ($OD_{600}$) of 0.6. Formaldehyde was added to inhibit nuclease activity, and the PFGE plugs were prepared as described (Johnson et al. 2005). Restriction digests of PFGE plugs were performed using restriction endonucleases AatII, ApaI, BglI, EagI, NaeI, NarI, NnuI, PvuII, RsnII, SacII, SalI, SfiI, SmaI and XhoI, (New England Biolabs) according to the manufacturer's instructions. Digested and nondigested DNA samples were separated by PFGE in a clamped homogenous electric field system (CHEF-DRII; Bio-Rad, Hercules Calif.) under the following conditions: pulse time 1-30 seconds, 6 V/cm, at 14° C. for 24 h.

Hybridization Probes.

Regions of the light chain (LC) of the BoNT/A, BoNT/B and BoNT/F genes were amplified by PCR using the primers listed in Table 5 to generate DNA fragments for hybridization probes.

TABLE 5

Oligonucleotide primers used in PCR and sequencing reactions.

| Gene | Amplicon length (bp) | Primer name | Primer sequence (5' - 3') |
|---|---|---|---|
| Primers used to generate hybridization probes | | | |
| bont/A | 268 | bontAF6[a] (SEQ ID NO: 31) | GCTACTAATGCATCACAGGCAGGCG |
| | | bontAR6[a] (SEQ ID NO: 32) | CCCATGAGCAACCCAAAGTCC |
| bont/B | 592 | bontBF1[a] (SEQ ID NO: 33) | TTTGCATCAAGGGAAGGCTTCG |
| | | bontBR1[a] (SEQ ID NO: 34) | AGGAATCACTAAAATAAGAA |
| bont/F | 1317 | CLP10F (SEQ ID NO: 35) | AGAGAGCTCATGCCAGTTGTAATAAATAG |
| | | CLP10R (SEQ ID NO: 36) | AGAAGATCTCTTTGTACCTTTTCTAGGAA |

TABLE 5-continued

Oligonucleotide primers used in PCR and sequencing reactions.

| Gene | Amplicon length (bp) | Primer name | Primer sequence (5' - 3') |
|---|---|---|---|
| Primers used for sequencing of the neurotoxin genes | | | |
| bont/A2 | | CLP2R (SEQ ID NO: 37) | AGAAGACTCTTATTGTATCCTTCATCTA |
| | | CLP3F (SEQ ID NO: 38) | AGAGGATCCGCATTAAATGATTTATGTATCAAAG |
| | | CLP3R (SEQ ID NO: 39) | AGACTGCAGCAGTGAACTTTCTCCCCATC |
| | | HC/A2a (SEQ ID NO: 40) | CTGTATTTGGTACTTTTGCA |
| | | HC/A2b (SEQ ID NO: 41) | CGATAGAGTATATTATGATTCAATA |
| | | HC/A2c (SEQ ID NO: 42) | GGTAGCGTAGTGACTACAAA |
| | | 12243F (SEQ ID NO: 43) | GGATGATATGTAATAATGATATGTC |
| | | 12804F (SEQ ID NO: 44) | GGACCCTCAGCTGATATTATACAG |
| | | 13328R (SEQ ID NO: 45) | TCCAGATGTATCTTCAGATAGGAG |
| | | 13940R (SEQ ID NO: 46) | ATTAGGCATAGGCTCTAATTGGCC |
| | | 14681R (SEQ ID NO: 47) | AGCGCTATTTATAGACTCATTAAG |
| | | 15418R (SEQ ID NO: 48) | TTAGTTAGTCTATTATTAGTGATAG |
| | | 16337R (SEQ ID NO: 49) | ATACATAGCAATACTCATATTAG |
| bont/F | | FNTNHF (SEQ ID NO: 50) | GGATGATATGTAATAATGAAAGCAAC |
| | | CLP10F (SEQ ID NO: 35) | AGAGAGCTCATGCCAGTTGTAATAAATAG |
| | | CLP10R (SEQ ID NO: 36) | AGAAGATCTCTTTGTACCTTTTCTAGGAA |
| | | LC/Fa (SEQ ID NO: 51) | CAGAGATTGACTTAGCAAAT |
| | | F711R (SEQ ID NO: 52) | CCGTATAATCCATGCAGTGCATGTATC |
| | | F750F (SEQ ID NO: 53) | AGCAAGCACCTCTTATGATAGCCG |
| | | F1702R (SEQ ID NO: 54) | CGATTCTTCTGATAATCGTGTATC |
| | | CLP11F (SEQ ID NO: 55) | AGAGGATCCGCGCCACCGCGACTATGCATTAGAGTA |
| | | CLP11R (SEQ ID NO: 56) | AGACTGCAGGTTTTCTTGCCATCCATGCT |
| | | HC/Fa (SEQ ID NO: 57) | AATATAGGTAATGAGGTACAAA |
| | | HC/Fb (SEQ ID NO: 58) | ATTAAATGATTTAGTGACTAGTACT |
| | | HC/Fc (SEQ ID NO: 59) | AATGGAAATTTAATAGATGAA |
| | | F2106F (SEQ ID NO: 60) | GTTGGATAGTATCAAATTGGCTTAC |
| | | F2729F (SEQ ID NO: 61) | ATAGTGGTAAGCTTAGTGAAGTT |
| | | F2826R (SEQ ID NO: 62) | GGAATCCTTACCCAGAAACTAATAC |
| | | F3198R (SEQ ID NO: 63) | CCAACATATCTTGTATCATTACAACC |
| | | F3245F (SEQ ID NO: 64) | GTGATGAGCCAGATCCAAGTATC |
| | | F3260F (SEQ ID NO: 65) | AGTGATGAGCCAGATCCAAGTATC |
| | | F3506F (SEQ ID NO: 66) | GGCGATCTGGCATACATTAATGTAG |
| | | KM425R (SEQ ID NO: 67) | CTGGTACATATGTTAATGATAGCCATTCC |

[a]Referenced in Marshall et al. 2007

PCR primers were purchased from Integrated DNA Technologies, Inc. (Coralville, Iowa), and PCR reactions were performed using the GeneAmp High Fidelity PCR system (Applied Biosystems, Foster City, Calif.). PCR conditions were optimized for each primer pair utilized. Total genomic DNA was isolated from *C. botulinum* strains Loch Maree, 657Ba, Bf 81E-1133 and Af 84 using the ChargeSwitch gDNA Mini Bacteria kit (Invitrogen, Carlsbad, Calif.) according to the manufacturer's instructions, and used as templates in PCR. The PCR products were purified from agarose gels using the Qiagen gel extraction kit (Qiagen, Valencia, Calif.), and were radioactively labeled with [α-$^{32}$P]ATP using the Megaprime DNA labeling system (GE Healthcare Bio-Sciences, Piscataway, N.J.).

Southern Hybridizations.

The DNA samples separated by PFGE were transferred to a positively charged nylon membrane (Immobilon-NY+, Millipore, Bedford, Mass.) overnight by downward capillary transfer in 0.4 M NaOH, 1.5 M NaCl. The membranes were neutralized in 2 M Tris-HCl, pH 7.0 for 15 minutes, rinsed with 2×SSC (3M NaCl, 0.3M sodium citrate) and fixed at 80° C. for 30 minutes under vacuum. Hybridizations were performed at 42° C. for 16 h in a solution containing 5×Denhardt's Solution, 6×SSC, 50% formamide, 0.1% SDS, 100 g/ml herring sperm DNA (Promega, Madison, Wis.) and $^{32}$P-labeled probes at 2×10$^6$ cpm/ml. All hybridization solutions and buffers were prepared according to standard protocols (Sambrook and Russell, 2001). After hybridizations, the membranes were washed twice for 5 min, at room temperature with 2×SSC, 0.1% SDS and twice for 15 min each at 42° C. Autoradiography of the membranes was performed for 16-18 h at −70° C. using Kodak BioMax MS film with a BioMax intensifying screen (Eastman Kodak, Rochester, N.Y.).

Plasmids carrying neurotoxin genes have been identified in numerous *C. botulinum* strains of serotypes A and B, and in bivalent subtypes Ba and Ab (Marshall et al., 2007; Smith et al., 2007; Franciosa et al., 2009). Here pulsed-field gel electrophoresis (PFGE) and Southern hybridization analysis identified four new virulence plasmids, one in the proteolytic serotype B strain 14842 (pBot14842; approximately 260 kb), one in the nonproteolytic serotype B strain 10068 (pBot10068; approximately 48 kb), and two bivalent Bf subtype strains Bf 3281 (pBot3281; approximately 260 kb) and Bf 81E-1133 (pBot81E-1133; approximately 190 kb). The plasmids identified in the Bf subtype strains differ significantly in size and harbor genes encoding for BoNT/bvB and BoNT/bvF. The presence of two neurotoxin genes on the same plasmid is a phenomenon which has been described for the megaplasmid pCLJ found in strain 657Ba (Marshall et al. 2007; Smith et al. 2007) and for plasmids recently identified in three bivalent Ab strains (Franciosa et al. 2009). The identification of two additional virulence plasmids each harboring different neurotoxin subtype genes supports the hypothesis that plasmids serve as vehicles for the transfer of these genes to other *C. botulinum* strains and are responsible for the generation of dual neurotoxin producing strains.

Results.

Both BoNT/A4 and BoNT/bvB genes were found to be located on the same plasmid in the bivalent *C. botulinum* strain 657Ba. PFGE is a genetic typing method that has been used as an epidemiological tool to assess the genetic diversity of a variety of bacterial pathogens. PFGE was utilized as a method to identify large plasmids in nondigested DNA samples of Bf subtype strains Bf 81E-1133 and Bf 3281 (32419) and the Af subtype strain 84. Strains representing four serotype A subtypes (A1-A4), and proteolytic and nonproteolytic serotypes B and F were included in the analysis for comparison with the Bf and Af subtype strains (FIGS. 10-11). For example, the proteolytic and nonproteolytic serotype B strains Okra B and 17B and the bivalent strain 657Ba were included in this analysis as positive controls because they contain the virulence plasmids pCLD, pCLL and pCLJ, respectively (Smith et al. 2007; Marshall et al. 2007; Franciosa et al. 2009). To determine whether the neurotoxin genes are located on plasmids observed in the PFGE gels, Southern blot analyses were performed using probes designed to hybridize to all subtypes of BoNT/A, BoNT/B and BoNT/F genes.

In all PFGEs of nondigested DNA samples a significant portion of the DNA remained in the wells representing intact chromosomal DNA (FIGS. 10A and 11A). Beneath the well position was a band of sheared chromosomal DNA, characteristic of *C. botulinum* strains due to their high nuclease activity. Faint bands of DNA were observed beneath the sheared chromosomal DNA that represented linear plasmid DNA molecules.

The subtype A3 (Loch Maree) and A4 (657Ba) strains were included as positive controls and their plasmids pCLK (267 kb) and pCLJ (270 kb) were observed in the ethidium bromide stained gel beneath the prominent band corresponding to sheared chromosomal DNA (FIG. 11A). As expected hybridization signals with the BoNT/A gene probe occurred with the plasmids in the A3 (Loch Maree) and A4 (657Ba) subtype strains (FIG. 11B). Nucleotide bands similar in size to pCLK (Loch Maree) and pCLJ (657Ba) were observed for both serotype B strain 14842 and strain Af 84 (FIG. 11A). The proteolytic serotype B strain 14842 was included in the PFGE analysis of Af 84 as a negative control and as expected hybridization signals were not detected with either BoNT/A or BoNT/F gene probes (FIGS. 11B, C). Hybridization with type A and F neurotoxin gene probes produced signals that were observed only at the well position and at the level of sheared chromosomal DNA in strain Af 84 indicating that both type A and F neurotoxin genes are located on the chromosome in this strain (FIG. 11B, C).

Plasmids were observed in the PFGE of nondigested DNA of proteolytic and nonproteolytic serotype B strains and bivalent Bf strains Bf 81E-1133 and Bf 3281(32419) (FIG. 10A). A new virulence plasmid was identified in the nonproteolytic serotype B strain 10068 that was similar in size (approximately 48 kb) to pCLL of strain 17B. PFGE analysis of nondigested DNA of several other nonproteolytic strains revealed that all carried similarly sized plasmids (approximately 48 kb) (data not shown). Conversely, plasmids among proteolytic serotype B strains were found to be much larger; ranging in size from approximately 150 kb to 270 kb. Plasmid DNA molecules of varying sizes were observed in the bivalent Bf strains Bf 81E-1133 and Bf 3281(32419) (FIG. 10A).

Hybridization of the BoNT/B gene probe was observed with the 270 kb plasmid, pCLJ (657Ba), the 148 kb plasmid pCLD (Okra B), and the ~48 kb plasmid pCLL (17B), as expected. Hybridization with the BoNT/B gene probe was also detected with two newly identified plasmids, one in the nonproteolytic B strain 10068 (pBot10068), and one in the proteolytic B strain 14842 (pBot14842) (FIG. 10B).

Interestingly, both BoNT/B and BoNT/F gene probes produced strong hybridization signals with the approximately 260 kb DNA band in *C. botulinum* strain Bf 3281 (32419) (FIG. 10B, C), indicating that both neurotoxin genes in this strain are encoded on the same plasmid. The same neurotoxin gene probes produced weak hybridization signals with the 190 kb DNA band in *C. botulinum* strain Bf 81E-1133, suggesting that the BoNT/B and BoNT/F genes may reside on a plasmid in this strain. However, strong hybridization signals were also detected at the well position and at the level of sheared chromosomal DNA (FIG. 10B, C), which could indicate chromosomal BoNT gene location. Thus, in order to accurately determine the location of the neurotoxin genes in this strain, chromosomal DNA was digested with 16 different rare cutting restriction enzymes. Based on the nucleotide sequences of pCLK (SEQ ID NO: 1) (Loch Maree) and pCLJ (SEQ ID NO: 2) (657Ba) restriction enzymes were chosen based on their potential to linearize the plasmid in strain Bf 81E-1133, cleave it more than once, or not at all. The digested DNA was separated by PFGE (FIG. 11A), and Southern hybridizations of the PFGE gel was performed using probes specific to BoNT/B (FIG. 11B) and BoNT/F (FIG. 11C) genes.

Several of the restriction enzymes chosen did not cleave the plasmid at all since the hybridization signals detected were similar to those observed with nondigested DNA samples (FIG. 11B, C). Six restriction enzymes resulted in an increase in the hybridization signals with both BoNT/B and BoNT/F gene probes with the approximately 190 kb DNA band, while hybridization signals at the well positions decreased (FIG. 11B, C). This clearly demonstrates that the BoNT/B and BoNT/F neurotoxin genes are located on the same plasmid of approximately 190 kb in C. botulinum strain Bf 81E-1133 (FIG. 11).

Unlike the Bf subtype strains, the BoNT/A2 and BoNT/F genes were determined to be located on the chromosome in C. botulinum strain Af 84, despite the presence of a large (approximately 240 kb) plasmid in this strain (FIG. 10A).

DNA Sequencing and Analysis.

The nucleotide sequences were determined for the BoNT/A and BoNT/F genes in C. botulinum strain Af 84 using the oligonucleotide primers listed in Table 4 to establish the subtype of each neurotoxin. Sets of overlapping PCR fragments were generated for both BoNT/A and BoNT/F genes. The nucleotide sequences were determined on both strands of the PCR fragments derived from two separate PCR experiments. Sequencing reactions were performed using the ABI PRISM BigDye Cycle Sequencing reaction kit (Applied Biosystems), and the sequences were determined using an Applied Biosystems 3730×1 automated DNA sequencing instrument at the University of Wisconsin-Madison, Biotechnology Center. The nucleotide sequences were aligned and analyzed with sequence alignment software Vector NTI version 10.3 (Invitrogen, Carlsbad, Calif.).

Sequence analysis of the BoNT/A gene of strain Af 84 confirmed that it is a BoNT/A2 subtype gene, as previously reported (Hill et al. 2007). Furthermore, strain Af 84 is genetically related to other C. botulinum subtype A2 strains KyotoF and FRI-H1A2 (Hill et al. 2007). The gene encoding NTNH has been reported as chimeric in several proteolytic C. botulinum strains and was suggested to be a hot spot for recombination (Hutson et al. 1996; East et al. 1996; Jovita et al. 1998; Smith et al. 2007). Santos-Buelga et al. 1998 characterized the BoNT/bvB and BoNT/bvF gene clusters of strain Bf 3281(32419) and showed that although the BoNT/F neurotoxin gene was more similar to the nonproteolytic BoNT/F of strain 202F, the NTNH of the BoNT/bvF cluster shared a higher degree of sequence identity to the NTNH of proteolytic strains Langeland F and KyotoF (subtype A2).

Plasmid Alignments.

Figure 15:
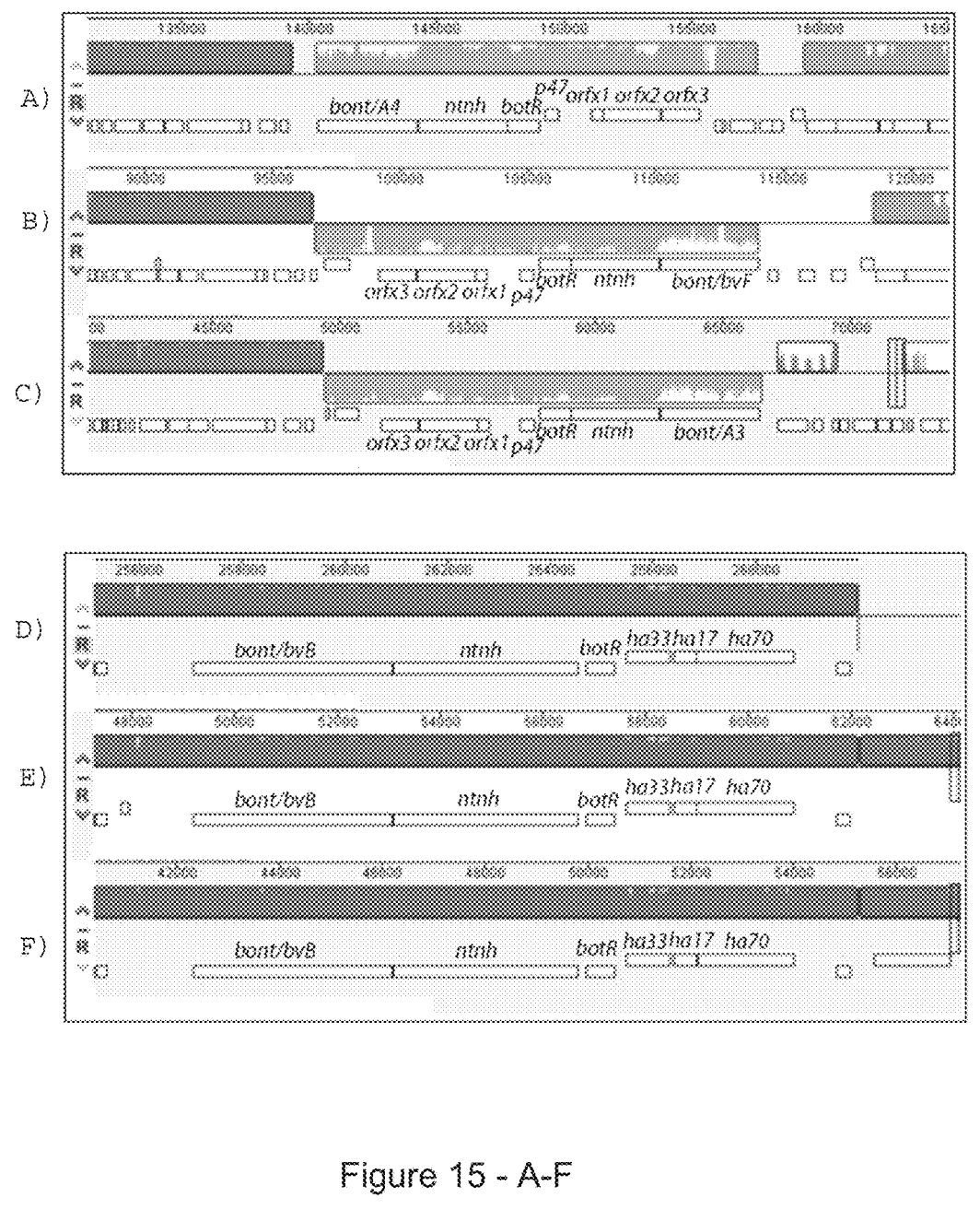

Plasmid sequence alignments were performed to determine the relatedness of the plasmid in strain Bf 81E-1133 to known plasmids in other proteolytic C. botulinum strains. Plasmid sequence files with annotations were obtained from NCBI for plasmids pCLK (strain Loch Maree) and pCLD (strain Okra B) and the draft sequence of pCLJ (strain 657Ba) was generously provided by Theresa Smith (USAMRIID). For strain Bf 81E-1133, contigs 18 (SEQ ID NO: 68; containing the BoNT/bvB gene) and 23 (SEQ ID NO: 69; containing the BoNT/bvF gene) were obtained from NCBI ABDP01000018 and ABDP01000023, respectively. Plasmid alignments were conducted using the progressive alignment option of Mauve 2.2.0 (Darling et al. 2004) with the default settings (FIG. 12). Figures were generated using the Mauve alignment viewer, which illustrates locally collinear blocks (LCBs) as regions without rearrangements in the homologous backbone sequence. LCBs below a plasmid's center line represent the reverse complement orientation relative to the reference genome (pCLK for alignments shown in FIGS. 13-14, pCLJ for alignments shown in FIG. 15). Sequence similarity plots are displayed in the LCBs, and the height of the sequence identity plot reflects the average column entropy for the region of the respective alignment (Darling et al. 2004).

Results.

The genome alignment tool Mauve was used to generate global alignments of three C. botulinum plasmids pCLK (Loch Maree), pCLJ (657Ba) and pCLD (Okra B) with two contigs from the draft genome of C. botulinum strain Bf 81E-1133. A total of 71 contigs (4,217,949 bp) representing the draft genome for strain Bf 81E-1133 were ordered using Mauve with either the chromosome of C. botulinum strain Okra B or strain Langeland F as the reference genome to sift out contigs comprised of prospective plasmid regions. Contigs 18 and 23 were identified as potential plasmid regions, based on the lack of alignment to whole genomes of strains Okra B and Langeland F (data not shown). Contig 18 (SEQ ID NO: 68) contained the BoNT/B gene, and contig 23 (SEQ ID NO: 69) contained the BoNT/F gene. Alignment of plasmids pCLK (SEQ ID NO: 1), pCLD (SEQ ID NO: 4), and pCLJ (SEQ ID NO:2) with Bf81E-1133 contigs 18 and 23 (FIG. 13) revealed eight locally collinear blocks (LCBs) with at least some portion of them found in pCLK (SEQ ID NO: 1), pCLJ (SEQ ID NO:2), and pCLD (SEQ ID NO: 4). The LCB containing the BoNT/A gene cluster for pCLK, pCLJ, and the BoNT/F gene cluster for contigs 18 and 23 also identified a region in pCLD that contained a small degree of sequence similarity although this plasmid lacks either BoNT/A or BoNT/F toxin gene clusters. In backbone view, the alignment of plasmids pCLK, pCLD, and pCLJ with Bf 81E-1133 contigs 18 and 23, identified regions conserved in only two out of four of the plasmid files, and also regions conserved in three out of four of the plasmid files (FIG. 14).

For BoNT gene cluster analysis, alignments were generated using pCLJ, pCLK, and Bf 81E-1133 contig 23 for BoNT/A and BoNT/bvF gene clusters (FIG. 15A), or pCLJ, pCLD, and Bf contig 18 for the BoNT/B cluster (FIG. 15B). The LCB containing the BoNT/bvF cluster in Bf 81E-1133 (contig 23) and the BoNT/A3 cluster in pCLK is in the reverse complement orientation relative to the BoNT/A4 cluster in pCLJ. The alignment viewer was magnified to observe the similarity of the ORFs in both toxin gene cluster types, and revealed that the greatest amount of sequence variation occurred primarily between the neurotoxin genes rather than the other ORFs in the toxin gene clusters. When viewed in the backbone view (FIG. 16), islands were identified that were unique to either Bf 81E-1133 (contigs 18 and 23) and pCLJ or Bf 81E-1133 (contigs 18 and 23) and pCLK, but none of these correspond to regions contained in the ORFs of the toxin cluster. Analysis of the BoNT/B gene cluster revealed a conserved sequence with high sequence identity for the entire LCB that contains the ORFs for the B toxin cluster (FIG. 15B).

Surprisingly, a region of the BoNT/F NTNH of strain Bf 81E-1133 spanning 277 amino acid residues was found to be homologous to the corresponding region of the NTNH of Alaska E (Table 6).

TABLE 6

Amino acid identities of regions of the BoNT/F NTNH of *C. botulinum* strain Bf 81E-1133.

| Strain | % Identity of amino acid residues of NTNH | | | |
|---|---|---|---|---|
| | 1-294 | 295-572 | 573-1131 | 1132-1168 |
| 657Ba[a] | 99.0 | 76.0 | 91.0 | 63.8 |
| Loch Maree[b] | 88.8 | 76.0 | 96.8 | 72.2 |
| Alaska E[c] | 83.3 | 89.9 | 80.8 | 52.8 |
| Langeland F[d] | 90.8 | 80.5 | 92.1 | 88.0 |
| 202 F[e] | 72.7 | 72.0 | 86.0 | 88.0 |

[a]NTNH of BoNT/A4 cluster
[b]NTNH of BoNT/A3 cluster
[c]NTNH of BoNT/E cluster
[d]NTNH of proteolytic BoNT/F cluster
[e]NTNH of nonproteolytic BoNT/F cluster The BoNT/E gene cluster is located on the chromosome in strain Alaska E (Acc: CP0001078), but isolates of *C. butyricum* producing type E neurotoxin have been associated with four cases of infant botulism (Aureli et al. 1986; McCroskey et al. 1986) suggesting the lateral transfer of the neurotoxin gene. Hauser et al. 1992 suggested the type E neurotoxin gene was located on a plasmid in two *C. butyricum* isolates, however other researchers have reported the toxin gene being chromosomally encoded in toxigenic strains of *C. butyricum* (Zhou et al. 1993; Wang et al. 2000). The acquisition of the BoNT/E gene by toxigenic isolates of *C. butyricum* is presently unknown.

Sequence Analysis of the BoNT/bvF NTNH of Strain Bf 81E-1133.

Pairwise comparisons of the amino acid sequences of the nontoxic nonhemagglutinin (NTNH) of the BoNT/bvF cluster of strain Bf 81E-1133 with the NTNH of several strains of serotype A, strains of proteolytic and nonproteolytic serotypes B and F and the nonproteolytic serotype E strain Alaska E were performed using the AlignX (ClustalW) module of Vector NTI version 10.3 (Invitrogen, Carlsbad, Calif.).

The BoNT/A gene of *C. botulinum* strain Af 84 has been reported as an A2 subtype (Hill et al. 2007). However, the nucleotide sequences of BoNT/A and BoNT/F have not been determined. Thus, nucleotide sequencing of the BoNT/A and BoNT/F genes of strain Af 84 was conducted to establish each neurotoxin subtype. The BoNT/A gene exhibited 100% identity to BoNT/A2 of *C. botulinum* subtype A2 strain KyotoF at the nucleotide and amino acid level (data not shown) and was confirmed to be a subtype A2. The results of the sequence comparisons of the BoNT/F gene of *C. botulinum* strain Af 84 and the four known BoNT/F subtypes are presented in Table 7.

TABLE 7

Nucleotide and amino acid identities of BoNT/F among strains representative of the four serotype F subtypes.

| | | % Identity (Nucleotide/amino acid) | | | | |
|---|---|---|---|---|---|---|
| Strain | Neurotoxin subtype | 202 F | Af 84 | Bf 81E-1133 | Bf 3281 | C. baratii 43756 |
| Langeland F | pF[a] | 94/88 | 96/92 | 92/84 | 92/84 | 83/74 |
| 202 F | npF[b] | | 94/87 | 96/90 | 96/90 | 81/70 |
| Af 84 | pF[a] | | | 92/84 | 92/84 | 82/72 |
| Bf 81E-1133 | bvF[c] | | | | 100/100 | 80/69 |
| Bf 3281 | bvF[c] | | | | | 80/69 |
| C. baratii 43756 | F (baratii) | | | | | |

[a]proteolytic F
[b]nonproteolytic F
[c]bivalent F

Although *C. botulinum* strain Af 84 is a bivalent strain, the BoNT/F amino acid sequence differed by 16% from the BoNT/bvF of bivalent strains Bf 3281(32419) and Bf 81E-1133, and it showed the highest level of identity (96/92%) at the nucleotide and amino acid level with the BoNT/pF of proteolytic *C. botulinum* strain Langeland F. Because the toxin differed from the other BoNT/F subtypes by more than 2.6% (Arndt et al., 2006; Smith et al., 2005), it was classified as a new neurotoxin subtype named BoNT/F5.

The amino acid sequences of the BoNT/F subtypes vary more than the subtypes of the other neurotoxin serotypes, ranging from 10-32% identity (Smith et al. 2005). Even though new subtypes are defined by their amino acid sequences differing by 2.6% (Arndt et al. 2006; Smith et al. 2005), the amino acid sequence of BoNT/F of strain Af 84 differs from the other BoNT/F subtypes by at least 8% and thus represents a new subtype BoNT/F5. Despite strain Af 84 being a bivalent strain, BoNT/F5 shared higher homology with the BoNT/pF subtype of *C. botulinum* strain Langeland F rather than the BoNT/bvF subtype of bivalent Bf subtype strains (Table 7). The BoNT/pF gene is located on the chromosome in strain Langeland F (Accession number: CP000728), but toxigenic strains of *C. baratii* have been found to produce BoNT/F (McCroskey et al. 1991; Gimenez et al. 1992; Hall et al. 1985; Harvey et al. 2002). The mechanism of BoNT/F gene cluster transfer to strains of *C. baratii* is unknown at this time, but virulence plasmids carrying the BoNT/F gene cluster may be involved.

Since the BoNT/A3, BoNT/A4 and BoNT/bvF toxin gene clusters exhibit identical gene content and organization, it is unclear whether the entire neurotoxin gene cluster or a region of the cluster is being exchanged between the highly homologous plasmids pCLJ (657Ba), pCLK (Loch Maree) and pBot81E-1133 (Bf 81E-1133). The gene encoding NTNH was targeted for analysis since it has been reported as being chimeric in several proteolytic strains and is suggested to be a hot spot for recombination (Hutson et al. 1996; East et al. 1996; Jovita et al. 1998; Smith et al. 2007). Pairwise comparisons of the amino acid sequence of NTNH of the BoNT/bvF cluster in Bf 81E-1133 with the NTNH of several strains of serotype A, proteolytic and nonproteolytic strains of serotypes B and F, and to serotype E strain Alaska E revealed that it was highly chimeric (data not shown). Four different regions of the BoNT/bvF NTNH of strain Bf 81E-1133 were identified that exhibit a high level of homology to the corresponding NTNH region of five different strains (Table 7). The amino terminal region of NTNH comprising amino acid residues 1-294 exhibited a 99% identity with the corresponding region of NTNH of the BoNT/A4 cluster of strain 657Ba (Table 7). However, the next region comprising 277 amino acid residues (295-572) shared the highest level of homology (89.9%) with the corresponding region of NTNH in the nonproteolytic *C. botulinum* serotype E strain Alaska E. The largest region of NTNH (residues 573-1131) was most identical (96.8%) to the similar region of NTNH of the BoNT/A3 cluster of strain Loch Maree. The C-terminal 36 residues showed the same level of identity (88.0%) with the corresponding residues of both the NTNH of the proteolytic strain Langeland F and that of the nonproteolytic strain 202F.

Results.

Sequence analysis of the BoNT/B and BoNT/F genes of strain Bf 81E-1133 revealed that these genes were identical to the BoNT/bvB and BoNT/bvF of strain Bf 3281(32419) and to the BoNT/bvB of strain 657Ba (Table 6). Identical subtype BoNT genes on highly homologous plasmids in these strains provides strong evidence that plasmids are the likely vehicles for BoNT gene transfer. The location of the BoNT/bvB and BoNT/bvF gene clusters on plasmid, pBot81E-1133 (Bf 81E-1133) was analyzed in relation to the BoNT/bvB and BoNT/pB gene clusters on plasmids pCLJ (657Ba) and pCLD (Okra B), as well as to the BoNT/A3 and BoNT/A4 gene clusters on plasmids pCLK (Loch Maree) and pCLJ (657Ba) to provide insight as to how highly homologous plasmids carry genes encoding neurotoxins of distinct serotypes. The BoNT/bvB gene cluster of pBot81E-1133 is in the same position on the plasmid as the BoNT/bvB and BoNT/pB gene clusters of pCLJ (657Ba) and pCLD (Okra B) (FIG. 15B). Alignment of plasmids pBot81E-1133 (Bf 81E-1133), pCLK (Loch Maree) and pCLJ (657Ba) shows that the BoNT/bvF cluster of strain Bf 81E-1133 is in the same orientation and position as the BoNT/A3 cluster of pCLK and is in opposite orientation to the BoNT/A4 cluster of pCLJ (FIG. 15A). Smith et al. 2007 reported that the BoNT/A4 gene cluster of pCLJ was in opposite orientation to the BoNT/A3 cluster of pCLK, indicating recombination of the entire gene cluster.

Pairwise comparisons of the amino acid sequence of the NTNH of the BoNT/bvF cluster in Bf 81E-1133 with the NTNH of several strains of serotype A, proteolytic and nonproteolytic strains of serotypes B and F, and with serotype E strain Alaska E was performed and revealed four distinct regions (Table 7). The highly chimeric nature of the BoNT/bvF NTNH of strains Bf 81E-1133 and 3281(32419) suggest that the neurotoxin gene and the 3' end of NTNH may be the region of the cluster that is being interchanged between *C. botulinum* virulence plasmids. For example, a region containing a portion of the NTNH gene and the BoNT/bvF gene of pBot81E-1133 may replace a similar region in the BoNT/A4 (pCLJ) or BoNT/A3 (pCLK) gene clusters generating a BoNT/F encoding plasmid.

Nucleotide Sequence Accession Numbers.

The nucleotide sequences of the BoNT/A2 (SEQ ID NO: 70) and BoNT/F5 (SEQ ID NO:71) genes of strain Af 84 presented in this paper were submitted to GenBank and were assigned the Accession Nos. FJ968749 (BoNT/A2 gene) and FJ968748 (BoNT/F5 gene).

It should be noted that the above description, attached figures and their descriptions are intended to be illustrative and not limiting of this invention. Many themes and variations of this invention will be suggested to one skilled in this and, in light of the disclosure. All such themes and variations are within the contemplation hereof. For instance, while this invention has been described in conjunction with the various exemplary embodiments outlined above, various alternatives, modifications, variations, improvements, and/or substantial equivalents, whether known or that rare or may be presently unforeseen, may become apparent to those having at least ordinary skill in the art. Various changes may be made without departing from the spirit and scope of the invention. Therefore, the invention is intended to embrace all known or later-developed alternatives, modifications, variations, improvements, and/or substantial equivalents of these exemplary embodiments.

REFERENCES

Arndt et al. 2006. J. Mol. Biol. 362(4):733-742.
Aureli et al. 1986. J. Infect. Dis. 154:207-211.
Bannan et al. 2007. J. Bacteriol. 188:4942-4951.
Bannam et al. 2006. J Bacteriol. 188: 4942-4951.
Beverley. 1988. Nucleic Acids Res 16: 925-939.
Blaiotta et al. 2000. Lett Appl Microbiol 31:343-348.
Bradshaw et al. 2004. Anaerobe 10: 321-333.
Brynestad et al. 2001. Infect. Immun. 69:3483-3487.
Carter et al. 2009. BMG Genomics
Darling et al. 2004. Genome Res. 14:1394-1403.
Dineen et al. 2000. Appl Environ Microbiol 66: 5480-5483.
Dover et al. 2009. J. Clin. Microbiol.
East et al. 1996. Int. J. Syst. Bacteriol. 46(4):1105-1112.
Eklund et al. 1988. Appl. Environ. Microbiol. 54:1405-1408.
Eklund et al. 1967. J. Bacteriol. 93:1461-1462.
Franciosa et al. 2004. Appl. Environ. Microbiol. 70:7192-7199.
Franciosa et al. 2009. PLoS ONE 4(3): e4829. doi:10.1371/journal.pone.0004829.
Gimenez et al. 1978. Zbl. Bakt. Hyg. 240:215-220.
Gimenez et al. 1983. Rev. Argent. Microbiol. 15:51-55.
Gimenez et al. 1992. Infect. Immun. 60(2):518-522.
Hall et al. 1985. J. Clin. Microbiol. 21(4):654-655.
Harvey et al. 2002. J. Clin. Microbiol. 40(6):2260-2262.
Hatheway. 1990. Clin. Microbiol. Rev. 3:66-98.
Hatheway et al. 1987. J. Clin. Microbiol. 25:2334-2338.
Hatheway et al. 1981. J Clin. Microbiol 14: 607-611.
Hause et al. 1992. FEMS Microbiol. Lett. 99:251-256.
Heap et al. 2010. J. Microbiol. Methods 80:49-55.
Heap et al. 2009. J Microbiol. Methods 78:79-85.
Heap et al. 2004. J Microbiol. Methods 70: 452-464.
Hill et al. 2007. J. Bacteriol. 189:818-832.
Hill et al. 2009. BMC Biol 7: 66.
Hutson et al. 1996. J. Biol. Chem. 271:10786-10792.
Hughes et al. 2007. J. Bacteriol. 189:7531-7538.
Jacobson et al. 2008. Microbiology. 154:2408-2415.
Johnson et al. 2005. J. Clin. Microbiol. 43(6):2602-2607.
Johnson et al. 1997. Clin. Infect. Dis. 25(Suppl2):5168-170.
Jovita et al. 1998. Curr. Microbiol. 36:226-231.
Lin et al. 1991. Appl Environ Microbiol 57: 2946-2950.
Lynt et al. 1982. J. Food Prot. 45:466-474.
Marshall et al. 2007. Biochem. Biophys. Res. Comm. 361: 49-54.
McCroskey et al. 1986. J. Clin. Microbiol. 23:201-202.
McCroskey et al. 1991. J. Clin. Microbiol. 29(11):2618-2620.
Neve et al. 1984. J Bacteriol. 157: 833-838.
Parsons et al. 2007. J. Bacteriol. 189:7782-7790.
Peck et al. 2009. Adv. Microb. Physiol. 55: 183-320.
Raphael et al. 2008. Appl. Environ. Microbiol. 74:4390-4397.
Rood et al. 1978. Plasmid 1: 563-570.
Rood. 2004. Virulence Plasmids of Spore-Forming Bacteria. In: Funnell B E, Phillips J G, eds. Plasmid Biology. Washington D.C.: ASM Press. pp 413-422.

Sakaguchi et al. 2005. Proc. Natl. Acad. Sci. 102(48):17472-17477.
Sambrook et al. 2001. Molecular Cloning—A laboratory manual, 3rd ed. Cold Spring Harbor Laboratory Press, Cold Spring Harbor, N.Y.
Santos-Buelga et al. 1998. Curr. Microbiol. 37:312-318.
Sayeed et al. 2007. Infect Immun 75: 2391-2398.
Schantz et al. 1992. Microbiol. Rev. 56:80-99.
Scott et al. 1978. FEMS Microbiol. Lett. 4:55-58.
Sebaihia et al. 2007. Genome Res. 17:1082-1092.
Smedley et al. 2005. Rev Physiol Biochemi Pharm 152:183-204.
Smith et al. 2005. Infect. Immun. 73(9):5450-5457.
Smith et al. 2007. PLoS ONE 2:e1271. doi:10.1371/journal.pone0001271
Strom et al. 1984. Appl. Environ. Microbiol. 48:956-963.
Umeda et al. 2009. J Clin Microbiol 47: 2720-2728.
Wang et al. 2000. Appl. Environ. Microbiol. 66(11):4992-4997.
Zhou et al. 1993. Appl. Environ. Microbiol. 59(11):3825-3831.
Zhou et al. 1995. Infect. Immun. 63:2087-2091.

SEQUENCE LISTING (71 sequences)

SEQ ID NO: 1 - DNA, 266785 bp, Clostridium botulinum
tgatatagtttaatagcttctttataattttccttttcaaattccttacgtgctaatttataagcagtatacatgcttcttccccctttaaattttagcttttataagccatatactttatttaattaattattatttcgcaaataaaaaaatgtataattactatattaaaatatagaaactatacattttatatttaaaatttaaatgttactttactatctttttttaaatgttacttcaccatcttttaaaagtattaatttagcattaaaatcatctccatttttcttcttaaaaccttttataacattagtttcacctgcagataataatttcttgatattagaaggagtaatagatttattggcaatggttttccatataacaaatttgcaaccatttttccaattagaacaattgtatcctttactaccttctattatatttccgtcacatagagggcatttgcctaaggcaatattattgaaagaggtggcaaatcctatagtattatccttttttaatattagtttagcactaaatttatctccatttttctttttaaaaccttttataatactagtttcttttttatttaataaatctttaacgttagaagatgtaatagatttcttagcaatagttttccatataacaaatccacaaccattcttccaattggagcagccataaccttttttaccttcaattatagttccaccgcataaagggcatttacctatagatagtctttctattaagattttatcaattataatattattatctaaaatgatatcaccaagatcttttttagcaagatttaatgcataatcaatatttttctcttgcctataaatttgttttaataattggccagtctgcactgttttttcttttgacatatcaatattaagtttatttaatatttcaattaatgttttacctttattagtacatgacaatgaacttttactttccataatatattcatattctttagcattttcaataatattacttctagtagctacggtacctatttctattccttgtaatatagctttatattcatcatcatcattttcatcgatttcttttttcttaaatggatttttaagaaaagtatttaattcagcctcagtgacctttttaggtttttgagtttctttttcagctagagataatttacaatctactatttcattttgattaaagttaggaatttgtttttgtttactttcttccttttcaaatttataaaaaccttcatcttttattacattccctttcaattctatagtatcgctccctatctgaattactactgatgtttcttcaactatagttttttcatttaaaaaattactgataaatctatttttgatagtattatatacaattaattccttctctgttagatcggtatccttaggtatttttatagttggtgttatagctgaatgactttcaatcttagcatcattaaatatttgacttgttattcttaaagatatatctatattttccttttgttttattattgatattatattattaaatttatctttttccttagttgctaagtattctgagtttgtcctagggtatgttacatagcctttttcataaagtccttgtaaaatttttaaagtatcattaagagagattttattccgagtaaacatttcattttgtaatttatctaatgaaaataatttcttgggggattttaccacctcttttttgattactttctttactatggccttctctttttttaactgctccaatctaagtaatgccttgtttttctcatctttagaacacttaaaatctttaactttagtcttaatttcttttccatttttattaattaaaacatctagctcataatattgctcaggtctaaaatgttctatttctaggtctctatcatatataaactttacaataggtattagtactctaccaacaggtagttttattccgccagcttttaaagttacaaatctggtaagatttattcctaataaccaatctatatatgttctagctaatccctccatatatacatttttagttttagaaatattgtttaaattttttagtccttctcttattgatacctctgtttgttcaggtagccaaagtctttttacttctttttttattttttcttctgaaaaaattctataaacaatattatttataattacttcaccttctctatcagcatcaccacaatttattatagtagttacatcttttcttttaattagtgattttataatattatattgtttttttttaccttcatcattaggtaatttaaacttaaatttttgtggaataaaaggtagttcttctaaattccatctagttcgttccctatccatatagtcatcaatatcatataatcttaacaagtgtccataagcaaaactaactatataattttcattttcgaagtatccagtatgtttttccatattacctatagctttaactatacttatagctaaactaggcttctctgctattattaactgagccatatattacaaccttctttctaaaatcctttactgttatttattatttcattgtaaaaaaataaagtaagctatatttaattttctaaatatagcttactttatttctttattattaagtaaccattcatatttttttaatcttttttcatttttatatatattttctatttcattttttattttcctaaataagttaggataattattaattaattgtacaaattcatttttaccagattgttcttcacctattaaattaccactaccccttaatttcaaatctttattagctataataaaaccatcattagtcgtagtcattacttgtaatctttcgctgttttttgaagatattaatatacagtaagattgaagactgcttcttcctactctgccacgaagttgatgtaattgtgccaagccaaaacgttctgcattatttattacaatagtagttgcatttggcacattaatacctacttctatcaccgtagttgctataattatttgggtttcattattcttaaatttgtttatctccttatctatttgttcttccttcattttgccagttaccatagatagcttgatatctttgtttttaaaaaaagtgttcatttctttatatatatcttcaattgaatctatgttttccatagattcgcaataagatttttctattagaggacatacaaaataacattgatggcctttttttatttctttaagcataaaattatatgctttctttttattgtttattaaagctgtttttattggttttctcccattaggcattgttttaatagttactatttctatattatcaccatacatcgtaagcgctaagcttcttgggataggtgtagcactcattgtaacataatgaatattatttgttttttctagaagaacagcacgctgagaaactccgaatctatgttcttcatcaattacagctactcctaactttttaaattttacatctttttgaattactgaatgagtgccaattataacattgtatactccctctttaattccttgcagtatttcttttttttcactagcttttaatgttccatttataaaacaggctttaaatggggtatcacaaagcaatttattaaattcattgaagtgttgctttgcaagaacagaagttggtgccataagtactccttggtaaccattttcgactaaaataattataattaaaaaggcaattacagttttaccagcacctacatcagcagtaagaagtgtatttaccttcttattcttttgcatttgatttagtattgtatcaatagccttaatttgatcttgtgttaatttaaaaggtaatttgtctaaaagcttttgatattctactaaagttcttattttgatttctgatttttttttactttttctgtttttattttctagttgaaattgatattgaaacaaagtatcaaatataaatcttcttttagctcctattatttgttctttgtataggggagcatgtatattgataagtgcttccatttcattttgtaacttaaattgttctagtaaattctcctctaagtattcagaatcatttattaactttagagcactttcaatagagttagttaaatattcatatgacatacctgctatttttgaatatataggcataatttttttgaagttctctgtttccttgcttatatatattggattaataatttgaatttgattattgtatttataatttatacttactgttccacatactatatattttgtatttatagataattttttatttataaatatattgttaaaccatataagacataaaggggcaccaaagtcgtcaatggcatttactttgatgtattgttttattttattgatatttatttttgtaatagttacagctatagaagttgtttgtccatctattaattgatggataaattgttgtttcctaaagtccagatacttacttgggaaaaatcttactaattcttctatagaattgatatttttctttttaaattgatttacctttttcttaggtatatccaaattgtctaaggatatcatctcctttggacctcctttaaatacctcgtgtgattgtttgtacaccgatttaatttatttattttaaacaatattaaatatttacaaatagataatcactatctagaaaaattaattgcttattatttttcttacaaaagtttattatctttttgtatttattaatattagtttccccaaataataatagatacttacttctttgtaataatatactagccgattgaattggatgaattatatcaacttctctttgaatgttagtatataaatattttgttttagaagaaatagtttcttctatatttctataaggagtaagaataaattttgcattaaattttctccctgtttggataatagtatcgaataatattacttcataattattattacaagggcatacaaaagtatttaccccatcttcccttataactgttttagttaatgttcttatttgtgaaataacttttgaccaatcaatactttgtcgcttaggatctgctaacattgaaaaagttatattcatatatactcccccttgtttttagctaaatagccatcatataattttagttaattattattacatattggcaacatttaaaaattgtattgtattgtccatattagtgatatctataacagcatataagatattgggacagttaattttaactttagataacatatcagcactttctaaaataactattatattttgtggtagctcaggcatattgtctaggaatatcggatttaataatttatttaaataagaacttattatattctcatcacctttaggtatataggtaacatcaaagattttgttattcatgtacatacataagtaaaaaggaaaattttcaaccatgaaccaactgaactttcctgaaaaatgttttagtaattcaacacaaggtactacatttaggtttttattgaaattaaatatattagtataaacagtttggccctggaaaaaatcagttttgagtgcatttttagttactaatatatctggtatttgagtatgcttaccttctaaatttattaatttgattatctgatcttttgtagcaaatcctaactggtttacaaaatttcttacttctaattctcttcttaataatccactcattcgtagatcgctcctttcaatgattatgttttattatgaattttttaataatatacaaaatttatgtaaaattaaaataatatataatttaatatacttaaatttgattttatattcattttcactgtgctataataaattataaatacaaaaaatatatttaattctaatgaaaaggtgtttgtgataatgcgacttgaatttattagtaaggttaaaagtaatgatattttaggtaaggatattatttctcaagatggacaagtattgcttaaatcgggcattaggttgacacaaagttacataaaacgattaaagaaattaggtattttttatattcatatagaagatgaaagattagaagacatacaatataattcacaattattagatattaaacaatttattgttcaatctattaatagtacagtaaagaatatacataacattaataatattaatttaaaagaatcctttgaaaaaacaaatgatattataggctctattttaaatattaaagaattaatttcaattctttttgatataaaacaatataataattatgtctataatcataatttagatacatctgtaatgtgcatttttataggattatcctatggattaaccaatgaagaattgacgtatttatgcattggtagcatattgcatgatattggcaaactagaaatatctaataatatattaaataagattacccctcttacaagtaaggagttaaaaaaatttaaaaagcatcctatatacggcaagaaaattgcacaagaacggttgaactttccagaaccaattattgagataattgaacagcatcatgaaagaatagacggtaaaggatatccctatggacttaaaggtaattccatttctatatattctaaaatagtttctatatgtagtgcttataattttatgagtaaaaattattactatagagataaatacaaagctaatgatgtctatgaatttatattatcaggatcggatacaatttttgataggaatataattaactgttttaaggatacatttgctatatatccattaggagctgaaattgagctatcaaatggagataaaggatttgtaataagacaaaataaaggattccctgatagacctgtacttagaatttttaatgataataactttagtttttattatgaagtagatttattaaagaatacaaatattactgtgaaaacaataatacaagataggtaagtatatagtacacttacctatctgatgcttattatattaattagaatcctagtaatcccctatcttgattctgatagatttttgcatctatcatatcacaactatggagcagaatgtcttctatagttttcatctgaaataccccatattcaccgttatgagataatatagcatttgttattatctctatatcttcattacttagtttattttctattttatcatttataaacataattttggttataaatgatatattatgggataataatgtatcctttctttttatatatccatcatcatattcatattcataaattttatctatatcatgcatcatagcaataagcattagcctatctttgttgagtttattcattggttgataaaatggattcacaacataattagttactatattatacatatttaagcatactccaaaagagtgtataaatagtcctcctaatttattttgatgaaatctttcagccgcaggtgccgttaaaaactgattccaggtattattgaaaacataagatgcaaaatcgttgtagggacttttcatttcatttacccattgcttaaattgtcttatcatagatttaggtatgttatatctttctatgaaattctctttaggtatgtttgtaggatttatattagtaatgtttatacttctttttttattatattcattcacattgccaataacatttactaccataccttctttaaatgtttctcttaacatgtctatattattaaaagaaacacattctataggatcattaaagcttagatccttaatacttactgacaaaagctctcctgcttttgtatttttagtctttattctattaataagacctgttatagatacaggttcgttaataatagattcctccataatttctttaataaaacaattttttgccattgtgacaacctccttaatttttagcttaaaaccattattgtatcttattagattattattacttaaaaaaataaatattgattacatataatttattatgtaaattaactaaatgtaaactaaaaaaaagctgaaaaaatttcagctaaactacacctatactaaaatatctttttttattgttcgttttaatttccctatagcattcttatataaatattgtatatattggtaagaaactttaaattcttttgctatatctttatattttttctcgtatataatgcgagatataattatacttttttctttctctgataaaccagataaagcatttttcataacaattttactttctatattattataattaatgtctgttttaccaagaaggtaatcagcactattttcattttccttgccatggacaatagagtctacagaaatggaattattctttaattgaatatgatttttaactaattcaggtaattcatcttctgataaaataccattttcatatccttttaattttctatgttgatatgaagaacttatacttaaagatccgtcaacattaaaattaaagaaactacttatttctgcctctatccagtagtaagcataagtggagaatttaacttttttactttcatcaaatttatcaacagcttttaggaatcctaggaatccttgctgggttaaatcttgtagctcaatatttttgtttttatatttatttgctactttgaaaattaaattctgatttttttcgattaaagaatttaaatactttttatcttttgttttcttatatttccctacataatatttattaatagaatcaatatcattttcatcaaaagattttattaataattctttgtcctctttaatttctaataatttaatataagagaacatatccatttgctctgcttttttatagttttctacaatcttttttattcttggcttttttttcttcttaaatggtattattatatccaaaatatctttgtcttgatttactattgccaaaaacatttaatattccccctttacattttagcttaagccataaatttttacctatttaattattattactttttataaaattactagttaatgtaaaggaatatcctttagaatctttattaaaaattacattattaatttcactattattttcacagaaatctattaactcaaaaaaaggtatattcttaatataaaacttatttgtatcaactatattttgtgtgaaatcagaacttgtaaatgcaaatgcagaattatttaataaagcaatagtattatctttattcaataatacatgtacatccataagttttaaaatttctattaatatataaggattaaattctttatcagatcttaaataattgtttaactgttgttttaataaacttgattgtttttgcattttatttttaaaatctgttatagatagtaatttactatctagatttacatatctgataaatttatcattgcaaaagcttagtaaagagtgtaattctctaatatttatagagctaatgataaaagtattttcagaattaaattgtaaagctaatagtaaatctgtgaaaatatatatgcaaggttttccattaattaattgaactataatttcattgttattattttgtattatataatgtggcacttaatatcacttctttctcttgtaataaattgttatcacaattgttggatagcatacgtaactcattaaataactcattagctacaatatcatcatctgtatttatgacattttcattgtcaatgaagatagaaaagtcttggtctttattatcataaattaatgctattttcataatctgtatcctccattatgtagttattaataatagatatatacaagattacaaaaattaaaaatgatactaatcgattttttaaaaacctaattagtatcatttttaatattttacctttacataaattttagagtttgtagtaattattttacttcttgaccttatatttgtactataacttaaatggattaaaacttagaatccatttatcatttttaaatttatctttgtcaaaatcatagacatatccatcacctattgctccttgaccaattgttccatctacgcataaaaaagcatgtatactcttattttctgtgcttatgaattctacatttttatgtggtttattaagtaaataattaattatttgtgttgtagtaaatattattctcacctcttttaataagccctatagaatttagtagttatattttttgcaactactatttgaattgccaattaccaagcttctaataatgctttgtcttttatatcataataaacatatcctgtaatatttttattagggtttataaaatccatgcagttatcacattcaaaataaccatcttcgattacatcatttaataattcaccgctcatagttgttatatcaccacaattaggacatatatattgatttttctttattagaatattcaattcaactaattcatttagataaaattcaacttttattaagtccacatcaatatcttctgataacctatttttttctctataagctctccaatttataggtatctctaataatctttgttttagtttattttttacgctcatatatttcctccgtatttttaattcacaataattttaatcctggaactaaatctatgaattaagtgtaattttctattaaatacttttctattgttgttactacagtatcttttgctctaatttcgcccataggctctaaactcatagcctctaaatcaaaattaaattttttattaatgatttcttttttatcagcacatttataagatttatcatagacaattagagatacttgcttatttttagtatcataacttgttgatactccaactgcaccccaaatatcatagatgattccgccgactgctctatcaactgtttcctctattattttccacatattttaacctcctaaatttactttttccgctcaaatttgaaattacgcactaaacttattctttaaattaaatcttttttcaaattccaaaactgatattctttcaacttcttttataaatttagcacaatcctcaccttcactgccataatcaataaattcaccttcaaatattagaatataatcattcatattatcttctatttcaagaaagtaactaccaaaaaaattatataaatcctctgggcttctataacagcaagttcctggttctacccatccatatacacgattagaatttttgtagtcgccccaaatcttttttaattcttggctttttaataattcttctaaaataaccttactttccattatgtcttctcttattgcttcttctaatgtgtcaaaattacagttaaaactaatatgttcagatgttatttcataatcatcactttgtaacctataaaaaatcatttaaaacttcttcctttcgtaataatttcatatagcaacataaacaatgtaatctatgttgctatatctttaatagaaaaattataaatatccaaatctattattttgattattataattatttaattgctgttgattaatgctgccattataactatttaattgattttgactaaaatttgtatttacattatttgaattattataattcttttcttttttcgctccttttggattccattgatctattttttcaccagtataatcattgttttcctttttctcttttgtaaactctagttgagcttttttcattagtacatagaatgattcttcagctaaaaacactctttttgctgattccaacaatggtattattagctcattttcttgtagcatcatataagatttattgctacatttataagtgccattttgtactatattaagcccttggcttttctgtatatttttttgtcctgttccttcttctattgttatcttccattttgaactacttctcatagcttcttcatagctaataataatttttcgaactaacagattattattacctgtatctatgtttttttgaaaagctatgtttgtagattgaacaggatttctactagctattttagaatcaaatcttctaaaatcaatattcttaaatgttccaacaaattgttttactaacaatttgttaggagcagttaaagcagagtaatagcctactctatttttaaatgcagtaatattaccatcacttaataaatgagcaatcaatataatctcttcaggatcaagattatagtatactgctcctcccttgtttttatttctcttatctattatcgtaattctaatatttgaatattttccaaatatattagagcttatataagaattatcagtaaactcatttggagttaactgatctataaattctaataccactccatctctacctgttttatagaagcatgtttcccttaattgtttaaacgccatataaatcctccttaaaattttagctttttataagccatatttattatttatgtatttattatttctttttataaaaaacatatggtttactaaaaagcttttattttgtatatatacaaaatagttaatttatataaaatgaaaggagaattttatgttatttaatatgttattattaacaatgatagggagcggtattttaggaacaattttattgataactaagaataaaattataaatttatttagtatggtgcctatattaactatgattattatatattcagcactaacatattcagtggatagagcaaaaatatccccgaaaaatactaataaatataaggttgtagaacaaaaagatattgttaatatagataaggataatgaatactacacattaaccgatgagaataatatgcaatgtaagataaagttgaatgatattattattattagtgctaacaaaagaaataaatacttagaaaagaggatatatgaatggagatatgaacctaagaactcatttgaaaagattaaattaagtgaaatgcaatattatggattaatagaaaatgatactataactaaacaaaaatatgtattaataaaatagaggaaataaaaaaatatattgtagtagaaataatacagatatataatattaaaagaaagcacaagaaatagatgcatatttcttgcgctttatcattatttttttatgtagttcactccttctcatatgtttttaaaactatataaacatctcatatataaaatatctggttataaaaaaaccaatacagaacatactaaatagtagaattataaataatatcttttttgatatttttattttatttgaaaacatatggtatatacaaaatgttcccataacaataaaaaaagcagctattaatgaataagtatttaatttaactttttcaattgaatagtagatacctatgatagcagtagctattgcaaaaggataaccataattctttttgatttctttgaattccatatttaacaccaactttctaatatattcatttaacatatatacattttaggaaaaataaaaaagcacattatttaaactaagtttaaataatgtgcttttcattgattatttattgttttaatataaaatctagcggccttaatattgtaattgaataagcctatattccagattctgcattaggtttttctttttccttttctttaggagcattatcttcagtagtatttttaatattattttttctttgtagttcttcagcactttttagtttaccatctaattcttcttgcattcttcttaaattttcttctctttgttgtaactcataggttctattttctaattcattctttctattttctatttcaatactgttttgcttaattttttctgtttctgcagctttttcatcttcttgtttttttatattaaataaagcttcgtatttttgcttatcaggtaataattcttgatactttttattaaatcttctttcaaattcttgttttttatctgtattttttattagtgatatagagtttttagtattttccattagcttattgatatcttctaaagattctaaagagacatattctgctttttcatatgccaataataattttttagcattttcttgcctttcattttcttttctcttttctaattctgctgctttttttctctttatttcttcaattctatctagaattggttgagagaataattcacttacaccagtattataattagctatgctaccatctccaggattaatatatttattaactactgttttgggtctagcaaaatctttgtttggtaaactttcatgtaatttgtccatataatttttccaaatttggcccggataagttgctccatataatccacctatactttgaggtgtatctgcccctacccatatggctgttgtgtaataaggagtatagccacagaaccaaccgtccttactgccatctgttgtaccagttttaccagcagcaatatgtctatttaatttaacattctttccagtaccaaatggcttatctaaaacgtcttttaatacatcagttataatataagctatttctttcccataaacttgtttagtattattttcattatggtatatttcatttattcctttatactttactgactttaaacaatcgggatcagtaaatttaccgttattagctaaactagcataggcagaagccatttctactggactagttccataagtaaatccacctacactagctatggggttattatcttctttagctattttcttaaatttcatattatataaatattctaaagctttattaggacctatatcatctaataatttaaaaggtattgtgttaatagaacgtgctaaagcatatcttaaattaacattacccctgtagcttctatctgagttagcaggtccattaggaatagcactatcatttactatactagatatgaagtaaccattttctagtgctggagcataagctaatataggcttaattgcagaaccaggttgtctataagataaaaagcctctattaaatttatcttgaggatttctgccaccaactatagctgtaacttttcctgtactgttatcaatggtaactcctgctccttgtacaacactatcaaaatcagttaatccgctgctaacattgttttgtaacaatttttgtgcttttgaatcaatagtagtatatatgttatatcctccgctacgtactttatggtcgtattcagtataaatttcactgaacttcttttcatattcttttctttctttattgtcattaaatttatatttaaattgaaaatcatctaacttcattaaatatctcacagtattatctattgcaaaggatgtaacgaaatcatcttttataggcttatttttttgtaatttgatatttattttttcttctaaagcttttctatattcgggctcagtaattttatcattttctagcatagcttttaatataacatttcttctatctatagtatttttataattagttattggattatacaatgatggattattaggaatagctgctaagaaggctgattctgataaagtaagcttattagcaggtttagaaaaatatttattgctagctgtttctatcccataagcaccattagcaaaatagatgttatttagatagtattctaatatctgttttttggagaattttttttctacttctttagatataaatagttcttcaaattttctgttcatagtttgcttgttagttagtaatacatttttaaccaactgttgagtaatggtgcttcctccttgcattgtatgtcctttagattttaagattatcaatacagcgcgggacattccttttatgctatatccattatgggtataatagtccttatcttcaattgatataaatgcattttgtacgttattgggtatgttggataattcgatatatttatatgaaaatggatttatagaattaattatattattatctttatcatatatattagtagcacctgttctaatgaacgtagtattatctattttagcaatcttttctttagcacttttcatggatagaaataaagagtctttatatttaaaataaaaaatgcctccacttaggaatataagtcctaataatatagaaaaaattcttataaatataattcttattttatgttttttaatattcaacttaatcaccttactttaataatttattgattgatcttatagaagtaataatacttattaataatcctataattaacaacataaataaatactgtagctttatgttgctaggaggtaccattgatataaatggtaattccatagatatttttttataaaccattgaatatccatacattgagaaataataagttattaatatgctaattatagtaattaacaaagttttaattaaaaacatattattaataaatatcttagatgctcctaattgatttaatatatctatatcatttttcctattttcaaatataattttatttgtatttgaaaataaaattattattgtacacataaaaattattaagaatacaatatttattttatttataatgttacatattttaattaattgatctattatctcatctagtacttctactttatctataaacttaaattgattctgtaataatttaatgttatttattttctttatattgtttagttttattacatacattacttttaaagagttgctagatatacctctacttaaattcttactggtggagattaaattgttttgaatatctttttttagttcattcttaccaatttctttatacttagcaacaaattcagcttcattcaaataattttttaatacttttttatcttgttttgtataagaattttttaaagttataataacttcagttttattattaatcttatctagtaaatgcttagagttaatatagttaaaataaaagactgaaattaaaataaagacacttatacatatgcatgtaatacctaaaaacattttccatttacttttaatttcatctatagctatagatgaaaagtaatgtatattacacaaaatatgttcccctttccctatcatagataattgatcctttttctaatttaataactctatgcttaaatttatttactaaaaaatcattatgagttgccataattataggtattttatgctttttatgaatgtcttctaaaatctttattacttcgatactgttacctatatctagattactggtaggttcgtcggctaaaataagttgaggattttttacaatagctctagctataccaactctttgctgttctcctccagatagctcacaaggcttattatctttgaagttatttattcttaattcttttaatgtttctatagttttttggtgtattttatgaagtggatatctttgtactcttaaggctaatgctacattttcatatactgtcatatcattaattagtttataatcttgataaattacaccggtacttctcttatacattactctctgatgcttagagaatttagtatctgcaatatttttatcattaacaataatattcccttctgatggaacatctgtattggccaaaagatttatcaaagttgttttccctgaaccacttttaccaatgacataaacaaattcattattaattttgcaattaatatttctcaggatttcaatatctttgatttttttagagacatttgttaattcaatcatttcttataacacatcctttcaatatttcaatttattagatatatattttaaagagtaatcaaaagttggataagattttactgtttctgatagttcaatatcactaatttcatttaaatacatctttgcatttttgttctcctctagatctagtgataataatgtacaattaaaccaatctattttttcttgagaactttgtgccactttttttagaatatctaacgcttcaattttattatttagctgccaaaggctcatagctataagcctatttatttcagtattatttgaaatactatagtctttaactatttgatcaaattgtttatttacatataactttgatatattattttccattaaaatcacccctataatattcattattttttatatatacgtgtcacgtaaaataattgcaaaaaataataagatgtaagcaaaaaatttacttacatcttatatattaattttttattgtttgcacaaattttgttctatttcttttaattttcttttagcttttattaattctttagtatatttaaatggggcttttgcttccatttcagctgatttcaatatttctttttcttcttctataatgttttttgtttgattagctttttcttcaaacttatttaataaattgtctattcttctggtgatccctatttcagaactactagattcaatttcatattgatttttatacttaacctttagtactcttgctaattggttctctgataataatttcttttgtattcctatttcaaatcccctatattttcctagatatactatatcatcagaaatagaaagatccttaaatttctctattatataagaacctacttctagcctatcttccataatatgattatcattagtataaaatatgaacttgaatttattttctgcatcttcttttgaatcatcttctttagttactatagtttccttaattctttgattaatatctatagatatatttgtatatctattagtaaatgtatttatacgattcttagcatttaatattttatcttgtagtctaaatatattatttttatgctttgcttctaataaactatatttgcttacttctgcttgcattttcattctttccattattaaaggattttccgaagctattgctaccattgtctcataatctaatgcaccatctcctagatcctccatttctcttatagttgtatcgcctttcatgaattgttctataaaattagcttttctagaaattgtttgccatgcaaatgcatcaaaagttcccttgcaaacatatctatagatcctaacttttgaatttatattaccttgtctaagcattctaccttcaagttgaattatctctgctggtttccatggaacatctaattcatgagtagcaataattctatcttgggcattcatgccttcggccattttactaattgagccaattaatattcttatatctccttctttaaaagcatttattagtttttgtttcttagcaggagttttagcattatggataattcctatgtcttctttaggaatacctaatgtatttaattcttttaccatttctgcatataaattaaaatctttattactaggagtaccataattgcaaaatatcagttgagttaatctaagttctttaccattttcccattcttcataaactttttcagcacaagcttttattttattatgggagtcgtcacctgcatttgggaacataagtctataatccaacgctatttttttcccttctgttgtaatttttaacatattatctttttttggatctacctttgatgtctttattaatttagctctatttgctagatatgatatatattctttaactcttgagcttggagtaacttctactggtataggcttacctgtgtctaacataggtaccggtaaattgatcatatctttagtgactacatcagatgcaattctaaataatgctgatagttcaggaatattattaaattttgcaaatcgttgttcaatttgtaaattttgtcctgtaacatcaacctctaatgagttaactattttgccaaatgtagatgcccattgatcaaagaaatatatatcgtgttcttttaaaatctgaggctgaagatatctttgcatagtatatacttctaccatactattactaacaggtgttccagtcgcaaatacaacacccttaccttctcctctaatttcatatagatattgaattttctgcagtaggtttgttgctctttgtgcatctcctacctgaattccttttatatttcccattttagttttgaaaaataagtttttatagttatgtgcttcatctaaaaacaatgaatccacacctatctgttcaaaattaatgaattgctctgtattagaagaagatagtttttttaatctagcttctaaattttctttaattttttctaattttcttatacttactctgtcttcttctgaatccatttcttttataaaattctctatttctgaaatttcatcttgaatatatttttcttgtttttctctcgatacagaaattctatcaaaagaactgtggcctattattatagcatcccaatcaaacaatgcgattttactaattaattttttcctattttgtttagtaaaatcttttggacttgcagataacactttagcatgaggatataataaatgaaactctcttgcaaattgtccagattctacaagatgattaggtattgcaaataaaggcttatttattgttcccatttgtttcaatttcatagctgatgctatcattataaatgatgacgataggtaattttttgatgtaatctccagattttcccccgtcctacaccgtacatgacagtttcctatcatacggcgtgccatcaacagtattttataaatttgtaatttggtagtcatactcgaacctttgaaattcgcataattattagttttattattactgttgactagtggctatccctccacagtttattatcactgattcataggtactataccaccgctcttcaactagattaaggaatgttatatgtaaccactttccattccaaacttcatagtctgtaactgactccatttctagtctttccacgttccaatactcctatctttacatatttacccttaggtgtccctctgagcctgtatgatttcatatgcctataacatatcaaggtctttcatagtaaaaattcttactcaacctcacatacttccgtattcggaaagcaacatttctattgcggcgccttttagactcgtacattcaggatttcgtcagtcattaatgacattctgaccataggtaatttatagactcccgacatatcatctacgtatcctaccgctaggacaatttccacagcattgtttctaatctgtttgggtaaatttctgtcgacttctacgagcttcacacctcaattatctttcagttacaggaattgacgcatgtcgtagttttagagtaggcgttttagagcgttaccccttcattccacctattggagtatcagttctccaagtgttgcattcaaatatattattttcatacaaccttgtgcgtaaccttttcaattacgaacgtgtcacacttttaccagcacctacacagtgtgccaacaatgatgacttaccggttaaacatctagcaatagcccttaattgattggacctaaattttatattagggtttttatatggaaatactagatgatctccattataccttctaggaacaacagaattaaatattttattatattgttcttctaatattgttcttctttttaaatctttaaaaatccaattattaaattcaatttgaatttcttctaatttttgtatggcaagcatactttccttagcattcaatattctttttttcttatctgtatcaggatctattatagtatcataaacattaggaacctttaaattaagtcctgctgcaactactgctatagcatcctttctttctgtaccatatttataattcaatacgctgtaaggacaaccgcatacagatatttcccaagatgtatcaattttattaaattctacatcaacatccttagcttctaatgcatatgatataaaatctttgtaaatatccttaggtacccatgttgctccaaagtttactgtaatatcttctgcagttattggatcgggttgaactttttctaaggcttgaacatttacctgaaatttctgatcaaatttatattcttgctttgctaaatttagtttttttcttacattaccacttaaataatcgtcttctgtttcccatcgctcagtagctggattaaagaagattagcttaccatttaagtagtctataacctcttttgctgatttacttactaagctagctattctactaaaatctaacttacctttctcacctaaagtaatataataagcttcttctatactatcagcttttgttattattttaggtaactgaattgttcttttagtaaatatatctcctttagaaatcttatcattttccacaatctctatggaacttataaggttataataagaatctttattataagctctactgttagcagtactgttaatatatccatatgacaaaacaaatttatcatatattgtattgagttttaattgctcttcttttaaaatatcatctgaacaattatctaattggacattaatgatatgttgaacttgatcttttagtgcaatcatattagtgattcttttaaatgttatactagaactagatagcttttgttcaactaatatgccattattattttgatatagtttattatttagtacaacatattcgtcttcaataatactatcatctgcccatataacatctttttcctctatagctatttctttatataccttttgtgaaatatattctaatatttcatttagtttttcttctaaattaccatctagttcgacggtatatgttttgccaaatggtcctgatatttctttaatatttcctgctatcattttaggattgttagaaaaatactcattaatttcattattaacttgcaaccattttgatagattactttcagtatgattttctaactttttttgtagtattaatatatctgaaactacagtagtattagtattaccaaaagcaatattaggcaatttgatagcagctatcaaattagcttttccccctattatttctcttactttagtagttttgctacccattgtaaagctactagtaattaatgcaactaaccctcctggtcttaccttatctaaagattttataataaaataattatgaatgctaagagcatatttattataattcttatcatgtactttgatatttccaaagggtacattgccaacaactacatcaaaataattatctaaaattctagcattttcaaagccagtattttgtatttctgcattttgatataattgctctgcaatggaagctgctaaaccttctttttctattcctataatattagaattactttttatatcttgtggcatatatcctataaaattcccgatgccacagctaggttctaatattcttccatgtttaaatcccatcttttttaatgcactgtatataaaagaaattatggtcttattagtataaaaagatgtgttgatagaagaaagagcatttctatattcttcctccgttaatagtttttctatcttttctctttcttttatatatttattttgttgaaaaagatcttgtaatcctccccaaccactgtattgagaaattaaatctttttcaaacatgtctgctcttctcacttgttgttttagttttttagctagttttatagctataatattatttttaattcttgttaaaattgaattattttgaatttgctttaactcaaagttttcatcttttaatttattattttgagttatatcaggattcaaattaaaaaaatcaatttgagctactttagattgagatttttctttagtaagctttttcttttttgatttttctttagttttatgtaatatctcctttcctttgtctaaaaagtcaaatagtgattgtgtaataaatgacattttaaattcctccttaaattttagcccaagccacaggccatataataattaattaataaattattattgcaaaaataaaaagtaggaatactttaaaatattcctactttttgcttataaagccctacttttcatatagtcttttctccagtttttataaaaactctttggattttgtatattatatcttcttaattctttaatacaatctcctggatccattctatttgcattttctaacacatcttttatagataaacatatattagatttttcttctcttttacatactccaaaataattaactaatttacttcttacggagttaacacttttatttaaagcagtagccatttccttatatgtcattttattatagttatttaaaatataattttcttgttgaacgctccatcttttggccatatattttagctaagttacgatagcctaaatcctccttcttttttaatatttatgtctatagattatataatccaagctctttattagatttatgtaacatacatataatgaatgtattcatggcagttctttctctttcagattttgcataactcatcatttttttatggaaagtcataagtccctctgaatcattattagctaccatggattttatatcatgatacatctcttcatatccttcagctttttttaagcatacgtataacatacactctaaatatccataggctttaatattatttgggaaatttctaatactatcaatagtgtttggtaatgttactaatatagcaacactttcggtagatacttcatctctctcttttttattattttttctcaatgctttaggcatgtttacttttcccccttaaacttcagcaataagccataatttattaatataattaattattattgcaaataaaaaaacatagtatattctttaatatactatgctaaaataattttattaagtttctagtaagaaaatcacatccaaatttggagaactggctgcttaagttcgttattaatctttgcattataataactaaaaccctattaattacttaaactttaagtctttttaattccttattaacttctatgcatttttgttttagtttttctttatttttaaattcattaatgtaattgtttgatatagattttgaaaactcaacaaagtcatatggttcttcttttttatattttgtttcatcttgaagcttattaataattatatcccaaaatttttcttcaaaaataactttagtgattcgaacacattcttcatataaatttgtacacttatcattatttaaagggatttgatagaattttaatgattcttttctatcatctttctttttaaggatatcaaaaattacattagaatccttacttttcattaatccgaaactaaaaaatagttcttctaaaatgattccatagttatcctctgtaaactcaagtgtttttatttgggcccgtattgcaataacaacccgtaatatattataaggaaaaatatttgatattttagttaattcggtaataaaatataaatcaagaattaactcattagcaaagttcttattattgctagaattgtataacccattatgagcaattttatttctaaatattggagcatcataagcaaaataaggatatgcagataaccataaaaatttattactttcaaatattttttctgcttttacacttagagttcctatgttttcatctatattttcaatttccttttcatcatttaaaattaaacaaaaatcataaaataggccctctatttgaattacggctaaattaataaatgattcaaatttttcgtgattgtataaatcatatagtgtttcaaatatctccttgcgttttataaataaatgatgatttataatattatacataattttttgaaatactttctcttcttttatagctagatcaatatcagtataatatttttctttatcatttgatttaagtattattttattttggattttacttggagtttgaaatagtaaaaacctaaatttcacatctgttgaaaagtcatatgctggttcataaaatctcttaagattgacatattcatatggtatatcaaataacttttttactccagatgttgcacgttcccatttttctctattaataaccctttcttttatatgtccaattgattcattagtaaagaattcttcaatcttttctttttctttcaaatttattctcttgcaatattctagttttctaaactggtaagtggaagtccttaatttagccttttgttcatcaatttgctttattctattatttatttccttcaagtctctcataatttcgctttgaacaagtatataattattaattaatgaattcataaattcattattgttttcatatttatattcttttttcaaatattcctcaatgttatcgctatcttctaatgcgttttgttcaaaagttcccatgtaaaatttaaaaatttcgttattaatattatccatatttcacccttcattcttattagtaatgttgtagttattgaactaatcataaatctattgcttgtacaaatcagtttatatattaaaaatacatttgttttatatggagattataacatatatgtcatagtacaatgttaattcctcttctcaagttctgatattaagtactcaagttctgtaatatttaacatttctcctattacattagctaatatttctgcatacttatcctctaaagcttttatattttttggtaaaattaaagttacctcatccataattaccctcctaatttttaaaattactttagattatataatcccaaatttttattacactcatgcataatacacataaatagtatattcacaagagttttatcttcttttgattttgtaaagctaataattttgttatgaaaatacattaaaccttcaacatcctttttaataatgtttgattctatttgattataaatttttatatatgtatcttctttctttatattattgcatattcctagaatattttctaaatatccatatgccttaatattattttggaaatctttaatactatcaatgctatctggtaataatgctaatttagcaatactttcgatagatacttcatctatttcttttttattctttctttttaatgttttagtcacgtttatttttcctccttaagttttagcaataagccataatttattatataattaattattattgcaaataaaagacatagcatattaaaaatatactatgttgaaagatcttattaacattgcattaatctccttctactgtttttataatatatcaccccatcatttgaattatttctatttttcacattcaatatggttcctgattttacttacctatactaatcagtgttaactttatttataaatctactttttggaaaaatggagactatcgttcattccatatttgaataatttttctttgccattctgataaatcatcatagttaatattattgggcaagcaactacttataattttataaatgttttcttcatgcataggaagttgttctgttaataataaaaattcaatactgtctaacttgtcttttaactcttttataatagtttcttcttctttgggaattacattaataaggtttttaattaatttttctaaattacttaacatttcgatttcctccttacaattttaatgtttttattaacatatttaactaaatataatctttgagatgagtttctaatcaatttcacatcaactactttttttattatcccttatatataagaagaaacaaattatagaaggcataaatttaagagcaagtgatacaactattagtgctgcaccaataatataaggagcatggttcttagatataaaccctagtaacatattgataattccaagtataccgactaaccgtgtagtaagtatataatacattaatacttcctccttttaattaataatttaaatctgtctcatatacattaaattttatttatctacttgcattactcatttataatccttattacttaaattgaaatatatttagatcctgcagttgctctttgaattccgaactaacttattcttctctaaactcttcaaatgctacaccatataagttgcaaacacactcgaatatacttataccaatatagcctctttcatttattatttttattagttgttttggaatttgtgtatctgaaaatataacatatgaatttacaccatctaaatcctcaattgcttctattaactctatataattcttactttcaaaaacttctactataaatttatctttctttttaaactttacactaatgaatttattacatttattacattgaatatggaacttgccttttatctcattatcttctagaaagatatagttactcaaggagtgtttatatccacaataaggacaattaatacttgtgtttcccattgttaatacctcttttttcataacttcccccttaatgcttttcctaaatttcatctcttgatcttatttttggattacgacacaatcaactattaaaattaactttgttttatagtcttaattgcttctatatgattaacgttagtcaaatgtatagcatagtcaaattctaattgataagtagatactttacttaatgcgttttcaatagaatcatcttgaattataacaatataaggactttcattaatttggaatactgttttagtttttattatatctttaataaaatcatataatttataattcttattgattttcaagagagactcccccaatgtttttgcaccagttcctggtttcccaattatcaaaattttctttgatttagaaatagctttaataaaaaactcgttaaattctcctcctgataattgcttataccatctgtttatctttttattaagtaaacttcttcttaatatattcatttgaagaaacccctttctaatacacaataatttcaggccctgtagctgctctttgaattgcgaacatattatgtctaattcattcttacaatattcataaacagtagtataatcgtttttcattataatttttttaaatattgaatacccaatttatatatcgcaatataaatttccccattgtaataaaaaaccagctaaaactattccaatagctatacgctttaattagtatcacttaaatagtatagtaataaattttgatgtcattacaatgccaagcagacctaaagttatcccaataaattcaagcaataattcctgtttccaattccaattgtttcctatttccactaatataacaaaaaaagttaaaattaaaaatatagctattattaacactttattacttaccacattatccctcccaaaattgtactaaagaatataattcatctttatcttctttagttattcctatatatttaagagtgatcttctcactcgaatgattgaaagtatccataattaggcctatattatacctactagctttatatgtctagtacccccaacttttccttaaactatgtgttccgaaattttctatacctaaactttcggctccttcttttagaatcctataagcttgtgtagtgcttataggactattaatcccttttctactttgaaatatataatcatttgaatttcatttatgtatcttatctttgaattgtgtattaatcttctacatattggtcatatactgctagagcttctcttaaaccttctatttctccttgggtatatagtttatctatgtcactaattgattttaatttatcgtattcatttgataattcttctattttattgtttataattagcttaaacatataattgtcatacttttttatttcatcaaaatttctaaaatagctactatgaatatcttctattggtatatttaaataagtgcacaatttatatggagaaaaaatatcgcttacttttctaaattcagccttaatgaagtgttctatatcccctctttcaaaatgaagttcttgttcaactaaataaaagtttaattgtttctcttcttttaaattatatagagcaagtcgtaagttagctatgtgttctttattctgtgccaatcataatttcccccttttatatcatgttttatttcgtcttataatcataggatgtagctacatctgttttagtatgatgtagttatatcatttcaaattcatgcttttctcgatcataattaatttttttagaacttagtaatttatctaaatcattttgcgagaaataaaatagtaaatcaaataattctctcttaagccctccatcttcatgaactatatctaatgtaacagaataatatttcacaccatgaagcttataaaattcaccaaatgctccaccatcaataaattctattttttttatatttaaaacttcatattctctcaactttcatattctccttttcctacataatttcattctcttattctcattaaacacaaaaaatctcttaaatttttataaaaatcattgctgtctccatatcttatgtcttcatctataatttcagcgaccgtattaatcatcccgtttaatatccactttacacattctctttcagacatattaggattgagtttttttcttaagccatcccaatttttaattatcatcgttggaccatagtaagtgtcaaaccttatttcatcaaatgaagatagcgtatttgcaataagctctagcctttccccctctacaaaacctgataggtttctatttacacattcttcttttaattcattcaataaatttttgaatccttcttcagttaaaatatttaatttagtagcatactctccataactgctatcagagatatttataatgttttttcccatagcctcgaatcctttctattttagttcgttttaatttcattacttaatgtttgaattatgacttacctatattgaaatataattttaatttatatatccagtttgtcacttgtagccctctattttttagttcaagtttaatcaaatctttatctcttttaaaatcattagataattcgtcaacactgccaaattccataatgccttgtgatacttcatcatacaatttatataactcttcatttgaactctcatgaatttgtatatttcttctattcctcatttgatccttagtaggtattggacaatattcttcatttttcatgattcaaatcctcctaaagtttgtaacgtaatattttcattcctggatctaatatttagattgtaaattaatattttgggggcatatcgaatgaaaactcaaaagcttcagtttcataatcaaatacaaatattgtattaaatactacaatttctttagtccctgtaccctttttttcttttacttgaaacttattatgaaattgatctttattaattatacttttaaacacttgtaaatcagtattttccatatgtaaccccccctaaaattcatacaataatttctatttcaattatatcttaatttttcaacataaatatttgatcattattattcaaataacaaagctaccattgtcttatttctatactttcaaatgctggctctacccaatatgcaaggcattgtaatgaaaaacttttttcttctgttaatccttttaatattgtatcaaacctttcagaacatggttcttcatctatcataggatcaatacaaactttacctatactttcttttcttgttattgaacatttataagaataaaaatctttccattgaattgttttaattattttatagtttttttctaagtttttatctttttcataaatatttattacaacatctttatctaaatattctattttagcaaagaaaaaaacttgattttctatagcttctttttctgtattaaattgaataggtactaatatatcaaaagatatatcacggccattattcattcgatcactaaaattcaattctaacatatattttatttgttttttcattttttcaacatcttgttttatatcagtatgttgtttatttttttcaaagtatctgatatttcattaagaatatttgtattgtaatcaactgttttcttgtttaaatattctttaagcttcatttcagcttcttttaaatttgttgtttctgcgattaatggcaaaatctttttctttttttgatattgccggatatctatatatttttaaaatattttttattttgcatttcaaaaattcaaatttactccaaaatatataataattagtgtctgcgaggtcagtatatgaatatacataagagtataaatatccctgctcttttaatatagaaattagcttatcttcaataaaatcattgatgaatctcacctcatcatatttattgatgttgaagtcttcacatagtttcttcacttgttcatacatttcaaaaaacatacgttcataaccttttaccatttcctgtttgattttcttttcaatactttcaagaaaaatatatttattgtcattgaatattttgtttgctataggtattaatttatttttaaaataaaattcttcatcttttttaattatttcagcttctttctttaatgttgcaatatttttcacaatagccctccttttttattaattaattagggtataataattacaatttttttcagctatttaataatgataaatattctcctattaacataggatttgctttatttttattatgcattttctaatttttctataattttttctataacttctgaggggtagatttcacacaagattctagcatatgcttgacatgctcttctttctatttcctctatctttacatctttagggaactttataattacatttcttatttctgcaccttttgccacaagcgataccacctttttataaattttatagataaaagttttgtttctatccatattctcaatataatttaaagaattaataaatacaataatactgtggctttatttgtattagacatatagtgatatttttcaaaataaaaaacacgatatattattttaatataccgtgttaaaaaaatttattattaatccaaattatataatcctaaatctttatttgcttgatgcataatacacatgaataatgtatttgcaatagcagcttcttcttcagattttgtataacctataagttcttgatgtaaacttatgagatcttttaaattatttttagatataatatttttcattgtatcaagtacttctttatatgcaggattctttattgcatgaaagaagccaaacatattttctaaatatccatatgccttgatattatcttgaaattttttaacgctatcaatagtatttggcaaaaatactagttcaacaatactatcaatattcttttctttcttttcttttaattccatattcattacaatctccactttaaattttagctattattagccatataattttatacataatctatatactcttatttccccatatgattcctaatccatttttctatatcatctttattaaattcatctttggctatactaagacctaattttattagttctttttgagtatagccaatattaatattattaagctgacataataaacagagtagggatatacccagtctcttattaccatctagcatacaatgattattaataactgaatagcttaagacagcaattttctctatgtcatctttgtataaatccattccagcaaaggtttgaaatggattttctaaagcacttttaagaagtgctttgtctcttactccatgacttccgcctgttttatttataatcttcctatgaagtgttaaaacttcctccattgaaaatactagcattttcctaattccttcaatgcttttagattgtcttctaaaaaacaatccattaatttctctttatttttatgtcctttattttgtttgttttgtaatgcaaccttgagcaaactcctgcgatttttcattttatttgttaagttttcataattctttaatgatttcattctagttcccccttaaattttagttaagctatattaaccatgcgatattatctaattaattattattacaaataaaaaacatagtatattaaaaacatactatgttgaaaaacttactattagttgtaagtattatatttttactatttaattttgtagtttttagatatctagggtcttattttaatttttttattctttcattttcatcttttattaatgaatttagctcattatgtaattcttctggagctttggaattttttttaccataaagttgatttacatagaaagtatgtttacctttagaagttttctttttgatttctatagtataccttttatttttgtaagttcttgtatatattacacatctacctttattaatcttatcatcatatgaagctacacagtttctattaagcacagcttcctcaattaaagctttcttggtttttattagcttatattcttttggcaattttaattttaaaaacacactattttcggggattttaattttttttacaaatttactattatatattattgctaattcattatgttcattaactaatctattaaaactctttatctttaaattgaacttttttttcatttttataatcataaaacaataatcttgtatatataaataatgatcacaatcatcaatataattttttacgtgtttcttataatacatttgaaatacttcactaacggaaaaacattcaatcagttctttatcagaaagactttttaatttttgatattcttctttttctatatatttcatagcattagccattaaatatgcattaaatattgaatatttatttatagaattatctagctctatattaaatcttttttcaaacaaatcttttttagagtgagattcccatacaagggatagttgtatagggaaagagttaacatgactttcattgtttagataatctcttaaaacatctttccaaaaaatatttttatttgaataataatccatgatgagttttgtcacatcagaatttacccagttaaaactttttaaattcgcaggaaaaaactttgaatttctatcacaataaatatttttttcatcatagactactagtttactattaattttcttgtttaaatttaaatttttcccatcataataagctgaattggattcgccactttctataataacgaattctttctcttcattatcttcacttttgcttcttatatattctatattacagtgattatattttatataagcttgtaacttaaattctgaatttttcacagcttcaaataatttcattaattgatctttttgaaacataaacaatccaaaattattttctgtaattttataatgtattatttcatatgtatcattatcaatgatgttatttagcaaataaaagaacatctcatatgtttttggatttctaagttcttttttcattttatttaatgtttctaatgtacatatacttttttcacaaaataaagggttataatattgttctttcatatcaattatcacctactaaaaatattatcttttctatgtgtttacattctatttagctactgcttttattgaatttatagcaaagcattataaaataaagaacacagtatattttttaaatatactgtgttaagaaaatttattattaatttattttttagattttctattttaatggtatagattttgtttaaacaaaatctatcttatttctatcataatgttgtaaaaaactatgataaattattttttcatctactactaaaatttttgccaatactggaactggcattgctatttttgtatttaaataatttatagttactaaatcataatagaagtcttcaccataagaacttaaataattaaaagtatttatttcttttatattttgaatggcatagcttaaccacattaaatttttagatgcaaaatattcatcatcacactcaatttctttattttggcatatttcaagcaatttatttaaatactccttaattttgtcttttctttcttctaataaactattaaagttgtttatttgtattattgctccaatatttctagcttgcaagtttaaagctaatcttaatttatcagactctaacatatatgtacgataaattaaattatttttatcttctccatattctttgtttactctagtttcaaaattattaagcccttctaaacctatatcgtgacaaccttctgcccaatgtacattaggttgtccgtcaccgtcttcgtaaaagtcaacccatttgtgattgttgaaattattcaatcgtgaatgatatctttctttaaaagccatattctcactagattcacacttactcaaattccgcacctctaatataaaatcgttcattacttattcctcctaaaattttaatccttttgttctaattttttaataaaatacattttttataagcagttataactatcctccattaaactttttaaaattctaatattatattcttctttcaaatctcctaactctttttggagatcttgcacatcgtttttaagcttgtttatgtttatataatctctattacagttcgctatatctaaccccatttctagatcagctatgtccatataaattgcttctattttgctagataatttcatatctagatcaaatattttataactaacctcttggattagttttttttctaataaactttttaaatccactgtgcgagaaaaaaagacattctcaaaatctcttgtattggagaaaaaattaatctctccatctttataaattaagtaatctcctgtttgagggtgtggtacaccaagggtagattgataagttcctaagcctggcatttcatcatacattaactctgaaatatatggttccaggtcttgatctaagtcttttactattttaaagtaatgattattcccatcatttaatttttcaaatttgtttttcatttctaattcccccttaaattttagctattattggccatatattctatttgattaattattatttcaaataaaaaacatagtatattaaaaaatatactatgttaaaaagttactattaattgcaagctctatctttctattacgaacagtaaataaatggtagtgggttagtaataccttttctacgtattaatttttctttttcaacactactaagtatcctattctttcctattgttttagccgagaatttactaaggtgtcttttaaagtaattatatgttgttttcttttcacattttcctaaggcacataaaatttgtctatttaaatctttacaacaaagtatgcctaattcaattctatttaggaatttcttcttcatatatggtcttatgttctcatccacttcaatatttctctttagatctttaaattctttatatgcatgtttagcattgttataataactttttgtgaatctcttttctaaaaatgcattcttagcattgtttatgtcattaaatgcccaactaatatcacttgatgcatgatattcatgaatagtaatagtgtgttctactattttttcttctggtggacatatatcatatttacattctgttataccacaacatttacaacattcaaatccctctaaaattgaacaactcaccgtatatttcttacaatccttacaactcatttttttctttcctcccttaaaaatctatccttaaatcttagttatattaaccatgtacgaatttcttggacctgtttttttgaattgtgaattactttaattgattgatttctctttttactatttcttctgtgctttcttttttccaactgtataactctgctgcaatcatatccccttctttacaattccagtaaggcatacttgcaaaagctccactatcagttaaataaaactctttttgaatgttgtattcttttgatttcacttttatcttttgtttgtaccaacgtgtgccagcataccaagtcgtttttttattagatacaactactaccttgatagttttatagtaaagaactggctgttcctcaattggttgattaacttcgccttcacaagcacataaaagtaaacttaaaatcaatattaaaaatatattctttttcatttctattccacctttttgaaatgtgaaacaactaactaaacaaatctatctctatatagttgaagtctgtataatcttcaaacatattttgaccttctaaatagtagaagacaattcttcgattatagtcaatctccataattatatacttatgtcttttacagtactcttctatccattttctcaaaacgtccttgaactccatcacttcaccgccatatgttgaactaaaaaactcgttttattaactattaatcattaatctttcatattgtaaaatttgttcatatgttaaccattctggtttttcattatcagaaaaactattatataattctttcattttttcaatctgttctttttcgttatttgcccacagatgatttacatttctgtttccatatcctaaataatactcacaatcaattcttagtctatctaataactgatatttaaagctatcttctttatttattggttttgatgtgaaatgtatttctaaatcatttttgatagggcaatttggttcgccttcaaaatcattactacaactacataactctggattatcacttccaagtgttatatctttatataagtttcctgtttcaatacatttataaactggcctatcccaatcatcaatacctattaattccattgttctaatattattactttccattttcaccctcctaatatttttcaatcttataaacttctttcttacacattaatttaaagattacgtcttaaattaaaatttctcaataattattacattttcattattttaaagtcacacaaccattttcatcgactttcctgagtatcttttgacatctcttacatgttacttcactagtttctcctatagagactttatcttttatgtcccatcttttattacatacactatagttatctacttctcccataacttctgctttaaatccaacatgtgtgattttacctcttttaattaaacatactttcataatgcaccttcccttctattttttagcttacataagccatatattccatttaattaattattatttcaaaacaaaaaacatagtatattaaaaacatactatgttaaaaaatttaatattaattgtaagttgtttcttagacctgttttatttgtatagtcaactactcttctaaatatttatttcctatctcacattcgtcaatgttaggttttatagttttacatatttcatataaagcacttaaataatcacttctatcattgaaatatatagcattatttgctattgcaaaagccttatcaaacctttttgaaatcgtcactcgctctacttctactatgtgcataccatatcgtattgaactttctagtaatctatcatcttgtttacttaaccactcttcggcttcacttttatctgtaaaacttgtaaaaatccctttttcttctttatccataatgtcataatatttcacattaattcacctcattttacttcataataatttcaattatggaactaatctttgaattacaaagtaaaattacattctgtcaaaatcaaaattattttcattacacagtttttctagttgctctatatccactatatcataatcacttattgaataagtatcaccaattggatgactatcatgtttatcatgatagtgaatataaaatatcccttcttcttctaataatagtaattcaactttatctactccatatttgttaatggcattattcatttctgtaactatctcagttataaacttatacggtttcgcttcttcaatagttccaatttcaaaactttgagtagcctcctccaaaattctatcttgtaattctttattgttcatgttgttaactaattcttttgcttcttcctcattgtttgcatttacttctatggttccaaatacattccaatttacttgataaatctttttactcatatttaaaacacctttccttttgcaataattcgcatttatttaaaattacttactatatttttggattacgaactaattccattgagacatttaaccacttgtgtataatagaactataatcaaagcattaatatttatcccattctaataggtgcaatcttttatcgttattaatatattctgttgccttctcctttgaaccaaactctaaatatttaaaaaataaaccgtctattatacttcctattaaaagaaattctccatctttttcagcttcaatattccatttcattcgcttgttaaatattggtcttgctaataatttgtttttttctatataattttcacattggttcaattgatgccttaagaccttatgctttttacagaatataaacttagtaatatttgagctaccgtcactgtatttacattttttacaaaagccctttaacattctttcgtatcctccgtttaatacgcatttttttcaatttataaattaaacattatgataaatttttataaattctccttttcttgtgaatttataagtagtattgcatacatgaatatatttgtattggccacaatcaccccaactatattcttgatgattacaattaaacatatttatcatatagttataatccattctatttatatacctgctggtacgtcatattaattccatttaaaaatatatcttcttatttttcccaagtggaaatcttctatagtaacattttccttttttttcttcccgctgaatacttttaaaaagatctttaagttcttctaatttatcttcaaagcaatcttttctaaagtaatctttattatttactctaaactcaactctatatctatttattttatatcccctccatatttgcattacgaattatctttcttcttgatctctagtgcaattttctacaggcagttctgattttgctaaatcatatattctgtcaagtaaatccattgaaaaatcaaatatttggctataagtactatagcttatcttacccacagaattaagaccatttaggaaatctgccatttctgactttattttttctttaggggtagctgtttctgagattccccaatttcccatgtaattcactcctctacattaatttcaagttcagttattgcatattttacaacagctgtttaaatgtcgtatcaatagccatatttatttttacgccatttacttgcttcttctgcacaatcctcatgcattaattcgcaccaatcttcatcattttcggaattacatacaccatcgtgataaacttcatcattatctatatccttttttgatataactttatggcaccaaggacattccacctcatctttatccgtatcaattaattttcctgataaatttttatatttcatctttatacaacttccttcctatttttttagcttacataagccatatattctatttgattaattattatttcaaaataaaaaaataagcatctgatagtctattaaaaccatcaaatacttattttaaaaacacatatttaattttcttatattattatttaccaagttcttttagtgcttctttattattatctataaaatcatccattaatttttctttatcttttttttctttatatttaataaactctatatattctattacttgcatctgctgctgctgtgatagacctttaacattttgaaatatcttttctgctaatatcatacgatcccttctctcttattgctgttatttatatatatattactatcatcactaatttttgtaaaggagtagttaatattcatttaattgcaaatacacaaatcataaaagtattttatatctatatatttatatgcctatcttttgttaggattttaaatttataccctatttaagaaatataaaaggacctgctaacatatgaacaggcccttttgtaaatacaaattagaatcctatattataatgagtttcagcacccttaaatccgatatcattagttaatttttcattatgatgcaaattggtagcgttaaatccattaacaggtaccttaatttcagctttacatggtatttgtactaattttcttattgtttgctttgtacctttctcttcatctaaaatataagttctagaaacataggcttcagctataaagctaatagttaagaacggattatctccagcataatcaaatttaaatatgcatgttccaccattttggtctagtttgcaataatatggagaagtataatgtgttccatggccgccaaatctatctaatctatgatttactgaccatttttttatactagctcttactccatcaatatatacaggacttaaagatatattcatggtatactctgtttctttacctttttcgtccaagtgatatctggtgaatgggaacttagcatcagtatttattatcatatgtgctgatccactactgcttccaccgctaccattactacccatattaggagtaaatcctgttgttttatattcccatctataacgctttacttgtctttctttttgaacacgtcttgttttttttgttgttgtttttatttttaccaaaacagcatattgtaaatattcatgcggacctccggaggaatcaggagcaggagagtgatttactgttttttcttgtacaatattataaccagcaaattgatttccaacttgttctcgtgctgaatccgtaaaacttttatttggatttataggaactgctataacatcactatagagccatttaacagtataatcttctacagtatagttttcagtagtccaatatttctcagtagtccaataacctactctttccatatggcttgtatctatataaggcggttgtttattactatttttataatcgtaaacacttgcagcagatacaagacttgattgaattattaatatgataaaggatagtataatgcttaataatctatttcctttcatattttcacttccttacatagttttatataattattattcaaaaaaaataaaaacaactattttggcttttaatagttgtttttattttaatattttatttaactatacaatatttaaatatatcataagaagatgaattatcattagaaaatgttatcataactaacatatttttggggaaatcagcaggataaaaattagcattagattcttttccatgttccattcttatatcactcatatctataacacaagaattaaaacaattataatatttaccattatctaattttaagccattgtcatcagcaaatataacttttgcatataatgcagattttgttttccctgcaacggtaatctttgtagaaaaaggcttttggtaatcaattaaagtatatgcattatcagatgttctcattaaaatagcatttttaactaatttatccgtccatacacgatttggatcattgtaactattagcttgaatgccttctctaccaagtgatttatcaaaaaaatttaatctttttcctcccatccaaggcgccccgttaccatatgggttaccagtgaaatcacctttccaaatggttatttctttaccgttaatgttttgtatttcttttttatatccactggttaactttttctgctcctcaggcatatatttaggattaagagaagggtcttttatatattgcactttttcattaataacttgtacataaggtttaatttgacttgtatacttatctaagtccattttttccattatatcaaaatttaatttacgtgaactaatactatttccaataccaagcaatattacaactaaaataagcccttttaattttttcttaaccatgtgtcactcctttctattctaaaatttaatatattttaaaataacactgctattttttgaatatcttttattttatcattttctttagatattttaactaaagtatttttaggataatactttgctgaataatctgttgcaccttcatacaactctactggactttcaaatgataaactaatattatcttttttaatattaaagtattgaccattatctaatttgataccattttcatccgctgatacaactttagcataagtcatgcttagtttaacatttggatctatttcattattcgtaataataaacggctttttataatctataaaaatgtatttatatttatcgcccattttttgtttaaatgcatacatatccttaaaaaccttttgatttttagctgttaggaattgcacatttaagtccatgttttctttgctacttatagtttctttacctggagagattattgtttcagtcacaaatccttctttatgggttgcttctagcattttttcattattaacatgaattactgttttgtctttagtataatcaaccttagcatttcctttataaacagttatatcatttttatatattttttgtatttctttgctaggctttttattttctttattctcttctactttttcttgtgtattttgaacagcttttgtatctttggatttattaagacccaccgctattccacctactataactacacaagcaataattattgctgttatcttctttttattcatataaattacctccaaattatgtctctatctatatattatttctatttttagcaatctttatatttatatattaagttaaaagcattatttatacaacaaaaaaacaaatatccattatagatatttgcttttttactaatttaatttttatcatgaataaatataccttatatgagcaaatcatgttgtttacatatctctttagataaagtttttattccggttttaaataaaacaatgatattatcacctttaatttcttggattttaccttctccaaactttttatgatatatgtttttgcttattatatcattgcttttatcattattatctttattcttatttattttttgtaattcatatataaaaacagaaggatctttttcattatataggatatataaattagctttagctctagtacatcctacatataatagtcttcttgttgattcaatcatttcatttactgcttccgtaggtattttctcctctttttgtttattaaaagtatcaaaaatgttattattaatatctgtaataataacatttgaccattctaggccctttgatgaatgtattgtatttaaagtaatgtttgcatcttcatcattttcttgaagaataacattatctatctcctttattctaataatgaattcatttattgtattagtagttttagctatatatttaatgatatcaactatctgagaatcagattttttatcattatttaaatactctttatattctaaaatattaaatacaaagcttataattttagcaggattagtatgctttgcgagctgctcaaaatcaaaacaaatatcattaattttttctaacatatattccggtatgtctaaactagaatggtatcttctcatatagtcaaaaatgttaagatcattactaaattcattgtattgtttacatactttatttagcattgatttacttatatatataggctttattttataaactatctgcaaatataattcggcattgttcatattttgactaaaataatagattcttaatatgtcttttataattttatttgttgataaagaaggaaatttagcttttatattgatatggatattatgattaatacaataattaatcataggtattgcagacatattatttctatataagatccctatattgccatttaaatttggaattaatttttcaaatattgttttattggcgctctcaaaatctgtaaagcttcgtaattctatacttccttctgcatcgttagaggcaatcatctttttattgaatctttctttatttttattaataaatatctcattgtatttgactaaatttttataacttctaaaattttggtccatatatattacttgggtatttttatattgtttaggcaaatttaacaataacttagggtcacttccttgaaactcatagatagtttggtcatcatctccgaaaaatgctaaattatatttgtccttatttaatttttcaattattttgtattgtaacgggctacaatcttgagcttcatctatttgcatgtattcaaatttattaacatatattgatttaatttctttatttgcggctaatagattgttagctatgattaacatatcatcaaaatctatataattatatgttttttgagttttataataattgctatatatatcaatgaaatctgtaggtaaatcaaatagttctattttagttttagatttttccattacttgctgtgggtatataaaattgtttttacacaatgatatcttattagaatatagttctagttcatcttctgaaatttgttctttattatgttcaaaatagattttagaaattatagttttcttattaataggatctttataattttcaatcattttatatttaatattattcattttaaaatatgttctactaattaaataacataatgagtgaatagttgaaaaatgaggactatatttaattgaatcaccaaagattgtattaaatctatttttcatttctaatgctgcagctttactaaatgaaatgcaagaaattaaattgggatttatatttctaactaatattaaatatccaattcgtataatactggataatgttttaccagaaccaggaacacttataactagtaccactccttcagaagttgtaacggctttcttttgtttgtcggttagttttatttgttttgtttgtattaattcgaaaaaatctcgatctgtcatctttccattttccctttcttcttgatatatttaatgagttcttgccctggttgtacatctctatttaaatctaatttgatcttttctttagcttttaacttatcgtatttttctttctttaataccgttgtataattgaatgatattttaaataattttgctatttttactgtttgtgttattataatttttttattgaataaatacaattcattgaatacaataattagcacattgctaattctctttgcatatttaattgtacaatctaaacatttaataatgaaattaatgtatacatctggcatagtatcgcccctttcaacataataagcagagaacataatcattatattctctgcttaaaaacccgttcactttaaacttctctttaattaatttgttattcctcaacattagccatatattctgaaacattactatacttctaataataattcgtaacatcaaaaagtacactttaaatcaaatatattacatcctcaaaatttgaataagataaatctatctatatataattattatacatttattaaaaaatttattaaaaaatacaaaaaaagtttcaaaaattagtacgataatatttatatgagataataaatatatgtaaagttaatatggcaaattgctaaaaccccctaaatcccccttttcaaaataaaaagtttaaaagaaattttaaactttttatttttttatgttcaatatttcttatatctaatatctccattagtggttccattaccattaattttccataagcctttcttagcacttctagcttctctttcacaatttgtaaatgtatcaacatattttacatttggagggaatgtactttgttgaccaaatccatttgataataacatagcattaaacattttagaatttatttcttgatcactattgctttcaggtatctctagccaaacatatcttagcaatctgccatatttatcagtattacttatatctttttctaaatatacagttttatcttctaacatagatcttgtatataaagtagcttctcttccaaagtcctcatgcttagtagtgtcttcaggacagttaaccccaatgaatctaaccctttccccagtatttaaaactatagtgtcgccatctataactctatatacagttgctttttttaaacttagattattttttccaggataattattacttttaatattatttattatggaaacattatccctcacaacatcttggcttaatttagtagcttcattaatattttgacagcccgtaagcaaaacagttattaaaataataggaataaattttttgatactcataaaattatcacctcttttatcagaatattttagtaaaatagcccaatgcacttaaatgtatttcttcagccatagtttatttcaatcatagttttagttgttgaattcaaaactttccccttaatttatattttaaacaaggaaatcattttaatttaaaacgataaagtattttacaatttatcccctaatatattgtcaataagtagatgatattgatcattcttttgacttaacaatttttctacagaatctccatttatccaaatatattttatataattgctatcatcaataatctcaataaaatattccccttttacaaatatggatttacaatcttcttttaattttactatgttataatattgcattcttttattggaaaaatcatcttttaatattatttctcttttaggttcacaatcatttgctttatttataagtatacttttatcttcaataatattaatcatctttaaaaactcctttataacattatttaattaattattatttcattattcaaaaatagtacagctctacaggtatggctataagcgttgatttaactagcattgcgctatatctaaatcgaatggacaagtttcgcgaaatcagcatttcgcgaacttatctaaaaaattaagacaatagtatattttgagcaaattttaattgaattgcttcaacatcatatgaaagttttttaaaataagaaataaatctttgtgggttgcatggaatatctataaaaaaatgtgcataacataattaataagtgtttagattgattatataagatatatattgtacataaaaaccaaatgagatgaatttaaagtataaaataaaaaatatcaatctagataagttgatggattttatagagaattgattcattttatggtaatatttaataataaagtaaaatttctttaagaggtctaaataaataatgagtatagagagatatgtattcaagaaaaaatttgtaaatttaaaatataaatatgggaacagacacttttggtgtacagaattcttcgttaatatagttggacgcaataaaaaagttattgaagagtaaaaaaatcaacagaaaggagacatgatgtcagagcaaataagtataaaaggatatatagatatttttctaagagcagcaagtaacaaaagatgcagctggaagaacaaaaaagcgccttaaagcttaatgctaataaaatgtccttatacgatgataaaaatacaatcagctaaattgataaattcttattattactatatagttaaaaaagtatgggaaaaatttaggaggaatgtatatgttaaagggaatagatgtatcagagcaacaaggggaaattgactggaaggctgtaaaaaacagtggaatacaatttgctattttaagagctggctatggtaaaaataatatagataaacaatttataaataatgcaaatggatgtacaagtgtgggaatgccatttggactatattggtttagttatgcttatacagaggatatggcaagaaaagaagcacaatattgcatagctcaagcaacaaagtataaaataagttatcctatttgttatgatcttgagtatgacactataagatatgctaataactgcggagtaactattacaaaatctttagctactaaaatggtccatgaattttgccaagaagtagaaagaaacggatatttttcaatgaattattctaatgaagattttttattaaataaatttgatagcagtttattaaagagatatgcactgtggtatgcttggtataataatagtctaaacagaaagtgtggtatatggcaatatagtgaaaatggaagagtaccaggaatagctggggcagctgtagatatgaactactgctatttaaacatggcagaaggggccaatacaaagctaaataataatacatctagaggagagcattatctaataagagaactccaacaagaaataaattcccagggatttggaaaagttgtagttgatggaatagcaggacaggcaactattaatagtgcaccaatttgtaagcaaggtgagagaggtggaataacaaaagttatacaacagatgcttataaacataggatatccagttggaagtcatggagcagatggagtctttggtgatgatacagtaacggcaataaaagcatttcaaagagattgccacttagtagtagatggaattgtaggaaaagaaacatgggaagcattatttagaaatttaaaataaatatcaaaaagaagttagttccttaattggagctaacttctctttttattttgaaaagtataaatattatcttgtaattttcttattcaataaagaaaggaactcaaaatcaatgaatcccatatacatagaattttctatgtatatcggtttagtgttttagcttatttttattatattcaagacatggatagcatgttttgagggaaaactatagagggtataaaatttgatgggtacccacaggcttgtgggggtcctagaggtgaagtaatgacagaagaataggcattagaagtttggtagggaatttaaaaaataggtcaaataggaatattaaaaaaagaaattataaaattaagaaacgaagcttgagaaaacagcaaaatatcttccaaagaaggtcaaatctataagattatagaagaaaaagaaaagcaaataacacataaattatgcccttagaggttcacgaatagtgagctacaactaggagtatgtccacccaatcacctttgtacttgccttgaaggtatgtgaagatacaaagatggctgggattagtcacaaatacactacgccgacgggtaccctaaaaaggacttgaaggacttagataaacttagtctataagtggcttgaaggtgtaaaattatgtatattagtaataactttaattttacaattttaaagctttattttaattgatttttttacaaagttataagaagataaagaatgaaaaatctttaaaatatcgaaaaacacattaagatttaaggaggaaattaaaaagcataaggttatagaaccttatgcttaagaaatattttaaacatatcattataaaagataattggagatttaaaatgataatatataattaagtattttgtacttgtaaagttcctcctaattgaagaggtccagctaaagctacataattaagattaaagatatcactagaattccatatgatttcagaaactgaattttctaatgataaatctatacttggggctgtattaacattatagttttcaataaaattaggaataagagttacacttcctactaatgtaccacctattaaagcaactgctaaaaatgatccaatacctggtacaagttctaatacaaaacctaatgttacaattaaaagcccttttatgatttcaaaagctacatcctgtgttttttcagtatattgtttattgattggagaaccaatttgttcatatgctatagtttgttctcctctatcatttttacctaatttaaatctatattcgcaaatagtttcacaaattgaagaaactcctactggtagatcaactcttgtagtagattcaagtcttagataatttcctaataaagatactttcaactcttgaatataaggtgtacaagtataaccacaagcgtttatgttatctaaattaattttcttaccttcttttaattttaatatatagctatatgttcctccttgtgcactttgattaactacttcgaattcatctcccttacttttagggaatttttttggtatagttgggagtaatatattttttaataatctatcttcagaaattagaaaacctgattgagaggctttaggaatagcattaggatcaatcttttgctgttgattttttgatccttttctgccatcagtcatacataatactcctaagatacttttagataaatcttcatctatttctgaataagcataatctacataacttggcttagtccacttccatttttcattattagatatatataaatttaaattaactgtattaaaaacgtaattgaaaaagtataaatttctttctaaccattctttaattaatctatgaaaataattcataataaactgatcatcttcagtcatcaataaacttctaacatcttcgttaaaataaaatcctttaacatcttcgcttgttggaataattataatagctgggtcttctgcattatttgattttgttcttatttttaaatctactaattcttcatttttatttttactttgaggaaagtgtggtaaatatttaagttttacttgaatctctaaatttgcagattcgaagccccctgtaccacttagatatttgcctataacattagccttaaaatttttaattggaattttaagcctaatatttcctccatctcctccacttataatttgccattcttggaatctacctttacaatctccatatttaccatctaaaagttcaaattgttcaggtgtaggatgtttaaatttaatggcttcattaacaatatctattggaactgcatatacggtatcccaatttaaagttgttgtttgcattagtttcagttcctccttagactaaatatttttatattctatttgctgttaggtttattgcttttttctaatgctccacctaataaataaattccttgaagtttaccaaatgttaccttaagctcactatctttatcaggccattgcatagcaccaatacattgttgcataaatgaattaattcccggtatagcgctataatcattatttcccatagcattgatatagcttataagcatttcaccaaaatttgttcctaaacctactgcaccaaacattatagcggtgccagccatcttcttagcacctatagcaattctttgaccagttgacatcggcttctttttcatatctcctaaagttcgtatactagtggtcccatcatctgagataagtccagcatcttcaacagcaatcctagaatttcttctatttatttcttgaagttctatatcagttactcctgaatcatttcttagttgtcttacatttgatctattaatataaattttctttctacctttaattgttgttgcttttgaacgtataagtttaccagccttagacaatgcagaaccagctaatttcatacttgcgcctaatatcatactaaagacagtgcctactacagctgaaactatcatgtcttcattagctttccattgagcttcttctacgtaatattctatttcaggttcatcatgaactttaagtattggaatttgctttccagattttgattctaatgctaattcatattcttgacgaaaatcaaaatgacctgttacacctcttccttgctcccatgttaagtcaaacaattctaaaacaattaaattattttgaagtgataatttcaattttccaggcttaaggaatgaatcaacatttttaccatcagaattttccactttcccgaatattatttgtttgttattagtaatagttagagtatttatgtcagctactatgtcatctacagaaataaactgtgaacttaataatgcttgttttaaaaaatgttctataaataaaggaaaactaataccaaaagctgcttgagtttttgttaattgtaacattctattatctaccgcatggcttggagtagaattagtattattttctaccatggacattgctgaaaaaatgcttgcatctaagtcaggttcatcattagcagtttctacacttgctgatccataagatacttgagtaggctttaaccattgatattctggaatcttagcagtttcatctaaaagtatatatgcaaatatctgttcaaattgttgtatattttcattaaaccaatttctaaaagctaaacttaaaaaatctttatcttctgaactcattgaaccatcagtatcagttagattgtaagtaactattaaaacatttttaagtttatcatcatttgtttttatttttagattgaattgttttccgtcattttctccagtaggatcattaatagttgttttagagtcaaaatatgttagatctacttgaattaacaagaaattttctgtagatgaattaaatacatcaccatcaagatcataggttgcagatttaatcggacatttgaatctgatatttcgtccatctgcacctgtggtcatttcccaactatcaaatgttcctgtcgctgtaaatgtcatttttctataactatatactgctttgaaatcttttgggtacaggttatcttttttaataaattcattcatagtcctaaatgatactgaattctcagtattccatcctaataaacttaaatctcctactactttagtttgaattctagatttattaataaacatttcaatattttttatattatttttgaaatatgaaagcattaatttatttaaatatttatctaaaattaaattatcttttgaaatttttaaggaattatctttaatatagaatgatgaactcttttcaggtattgaataagttccatctgagttaggattgattttcatacaaagttttatccaaacattttttaaaggaattttttcagaagaagttccaaaattcatatctaagtatccatcatcaattatacattttaagactggatgagatccttcaccttcatctgttaagttccaagatttccaagtaccatttagtgtggaattagtaattttggttccattaagttccatagaaaaagttttaggtataatttcatttatggagtaattttcttttgtattttttaaaattgtttttccccaatcgtaatatataaatggttttaaattattcattgatattcctcccttatgcgatttgcaataaattttcttcatttcctaataaaatagacaataacaatctattgagtattatttcttctaaaaatccattcttagttatttttttattaatatcttcattaatgatatataagttgaatctattttctaaatgtttattttttatatttgtaaactcatttggttttttattatttagtgaagacagttttaaataatctttttttagagctattaaggatattaaatcttttaaatcatatttttctaagatatctccagatttattttttatatgaaggtaacctccaataaatttaatcttgaagtattgataattaggactacaattttgatttattttttctaaattaattaatccactagaatttgataaagtgtcatcaaaattaaaagaaaatgtttgattcatattatacctccttttttattgcttagttgtgttaagttatatgaatattgatttctcttgaccttattgggacataatagtttcaccataaaatcattacttcccagaaaagagagaagcatcaatgaacaaagctagtaaaatttattgtcctaaatgccatagtaataatatttaaaaaattggtaaagtaaagatataagctagaaatattaatggaaagagtgcaaggaataactcgaacctgcggagcagaagtatcagcttatttgttatcctctttgtactttgtggcaaaggaacatttattcatcacaattactcaaattacattaattattgttgtaacgataaaaagtgtaatcatattttctttgtagtgaagcctatggctataactgccaatactatatatgtcaaattagattttaaaggtatgagattcccactccatattattttaatggcattggacctttatttcgttaattaaatttttacaagaagtacttctcaatatttacctaaattgtttaatgtaaaagtatctcatgtaactattgcaaattgaactgaaaagttagctacctatttccgattaaaatctaatgctcttattaaaagggattagcttatcagattatgatgaatggcatacagatgaaattattatatttataaatattaaacgtcattatctatggcttgtaattgatcctgaaagtcgtcttattatttcttatcatttatcatcatatagaaatacatagaaaacttttatcttattcaattatgctagggaatttggctctcctagagctataattactgacaggtctctttcttgcaatgtaacaatagaattaatattttaagatactattcacataaaagttcaaatttttaataaaatatttaaatcctagtataaaggattaaggggggttaattcctttgatgttgctaacaaattaatatctatatttatatttcattatagctttctacgttaacactattcatgacatgatttatcgcctacaggggtaattgaaattatttattcatctaaagctaaaaagaattgattgttagctgcctaatggcatactctatcgctttgtttcaatctacttatttttcaaactactttttcataattacttaacacaactgtttatatatatattaacatctctatattattttttgtaaacctaaaatataaattatatattaataagttcttctaatataggctttagcttttctaatgctaaatttttatttttatatacagattggcggcttatcttgagttttttagctatgtcaatatctttcatgtctttaaaaaatttcatatatataatattttgttgagtgttaggtaatatagatattaaatctttaaattcaaattctatatcattaaagcaactatcctgtattaaatttaaatttatatctgtaatttctgaattgtatataatttttttgtctctattctttttcatacaaatagataaacaatatctttttaaacatttactaatatatttatttaaatcattttcagtgttaaatttatttaaatcagcttttattagaataatccaaaaatgatttagtatatcattgtaattctcagataagttatattttttaataaatatatctataagatttttatagttcatataaatgtcttcaaattttttattatcatcttttaatatttttattataaagaataaatcttctattgttttcacctcatccattttttaagatttaattctatattatatacttaaaaagtaaattaatcaaatatcatccaatatttattaatattatataatattcattaatatacttaaaaagtaaattaataagtttacaaaaattgatttagttaagttatatatttatgtaacttaaaataaaaggggtgaatttatatgaatacttatggttgggatattgtctatggttgtagtaaaagagttgtaaatagacatttagaagagtatattgctaagaataaagttgagttcctatattctaatacagctaaaaaacaggaaataaaaatgatttttgataattgggaaattattaatggaggatcatcaaactttttaaggattaagacaccaatcaaggaaggatactttaaagttaaaaatacaacaatagatttaagtggtgttaatccagttctagaaataaagttagatttttttaatgatatttcaaatcctaatattaaggaacttaaatttaattttggatctgagtctaatgatgatattaagattatagtatcagatcttaatgggaaattacaggaagaggacgagttttattttaataaattattaataaatgcttttattcaaaatgaaaaacagatttcctatatatttgctagtttaaatgttacatctgacatagaatggatgaatcctaagcaatttaaatttgtatattactctccaactgataatagtgatggatatctatttattttatcagtagtaactaacagagatatttctaaattaagtactaatgttgacggaaatattttaggaaataatactgaggtaggattacttatatctgaaaaattatttttgcaaaacttagccttacctaaactttcaagtaatatgggatctaatataaataaaaataattttgaagttataagtacttctgatactacaggtagaattgtaaataatagtaccttaaattggtatggacttaaagttgccgcactttactattatcctaagataaataatttttctatgcaattatttgaaggaaataaattgaagatatcattaagaggattagtaaggcttactggattagaggctgtatattcagattttgaaatacaaagtattaataaattcgtatataattctacaaataagaaagcatattttgaagttgataacaatcctacatctagttataaatatcatttattcccgggtgatttgatatctttagctgtgttaagttctgtgacacattggtctataaaaagtattgaaggggcattaggatttgaattaataaataattttgtagatttaataaataatactataaaatggaataatctaaaaatttcacaggttactaatgtaaccttaaatgttggattttgtatacaaggaaatgaaaattaaagaaggtgagaatatatgaaaataaataataattttaacattgattctccggtagataataaagatgtagcaattgttagggggagaaaaacagatactttttttaaagtatttcaagtggctcctaatatttgggttgccccagaaagatattatggagaatcattaaatataaatgaagatcagaaatctgatggaggaatttatgattctaatttccttttaacaaatgacgaaaaagatgaattcttagaagcaactgttaagatattgcaaagaataaataacaatgttgtaggtgcgaagttattatctttaatttccacagccattcctttcccttatgaatataaacctggagattatagacaaactaattatttggtatctaaagataatcaacattattatacagctaacttagttatttttggaccaggagcaaatatagtagaaaataatgctgtttattataaaaaggaagattcagaaaatggtatgggaactatatctgaaatatggtttcaaccatttttaacatacaaatatgatcaattttatgttgatcctgctttagagttaataaaatgcttgataaaatctctttattatttatatggaataaaacctagtgatgatttaagtattccatgtagattaagaagtgaatttaatagtttggagtattcagagttagatatggttgattttttaatatcaggcggaactgaatataaacttttagacactaatccttattggtttacagataattattttattgatgctccgaaaaactttgaaaaatataagaatgattacgaaacaaaaattaaaaataataatgatattgctaatagcattaaattatatttagaacaaaaatttaagattaatgcacaagatatatgggagctaaatttaagctatttttctacagaatttgaaattatgatgccagaaatatttaataatgcccttaatcattattatagaaaagaatattatgtaatagattattttaaaaattacaatataaatggttttataaatggtcaaattaaaacaatattacctttatcaaaatataataaaaacattacaaataagccagaattagtagttaacttaataaatgaaaataatactgtattaatgaaaagcaatgtttatggggatggcttaaaaggtactatggacaatttttatgctgcttataaaattccctataacataggtgatgaatatcatattaattattcttatttaaataatgtaagtgtcgaagaaataaataatattcctcctatcaatgatgcagatatatatccttatagaaaaaattctgacccttttatacctgtatataatattacggaaaccaaggaaattaatactactactccattttcagtaaattatttacaggcccaagtgacaaatagtaatgatattagcttatcatcagatttttcaaaggtagtttcttcaaaagatagatctttagtatattcatttttagacaatacaatagattatttagattctataaaatatgatggacctattgatacagataaaaaatattatttatggttaaaagagatttttagaaattactcttttgatatgacagaaacccaagaggttaatactccatgtggaattaataaagtagtaccatggttaggtaaagctttaaatattttaaacacaggtaattctttcatagaagaatttaaaagtttaggaccaatttctcttattaataaaaaagaaaatataactatgcctaaaataggaatcgatgaaatacctaatagtatgttgaatctttcatttaaagatttaagtgaaaatttatttaatatattttttaaaaacaactcttattttgaaaaaatctactatgacttcttagatcaatggtggacacaatattatagtcaatattttgatttgatttgtatggctaaaagatcagtgttagctcaagaaagtttaataaaaaaaataatacaaaaaaaattgagttatttaataggaaatgctaatatatcatctgataacttagcattaatgaatttaacaacaacaaatacattaagagatatttcaaacgaatcacaaatagcaatgaataatgtagatagttttttaaatgatgccgctatatgtgtttttgaaagtaatatatatcctaaatttatttcatttatggaacaatgtattaataatataaataaggatacaaaagaatttatacaaaaatgtattaatattactgaaaatgaaaaattacaattgattagccaaaatacttttagtagcttagattttgattttttaaacatcgaaaatttgaaaagtttatttagttcagagacggcattacttataaaggaagaaacttcaccttatgaactagtgttatatgcttttcaggaactaagtaataatgttatcggagatgcatctggtaaaaatacatcaatagaatattctaaggacattggtttagtttatggaataaatagtgatgcattatatttaaatggatctaatcaaagtataagtttttctaatgatttttttgaaaatgggctaactaatagcttttcaatttatttttggttgagaaatttaggccaagatactactaaatctaagttaataggtagtaaagaagataattgtggttgggaaatttattttcaagatactgggctagtttttaatatgatagattctaatggagatgagaaaaatatatatctatctgatgtttctaataatagttggcactatataactatatccgtggatcgtttaaaagaacaattattaatatttattgatgataatttagtagttaatgaaagtattaaagaaattttgaatatctattcaagtaatataatttctttattaagtgataataatgcaagttatattgaaggattaactattttaaataaacctactacaggtgaagaagttttgagcaattattttaagaatttaaataattcatatataagggacagtaatgaagaacgattagaatacaataagacatatcaattatataattatgtattttcagataagcctatatgtgaagttaaacaaaataataatatatatttaacaattaataatacaaacaatttaaatttacaagcttctaaatttaaattattaagtataaatccaaataaacaatatgttcaaaaatttgatgaggcaataatatctatattagataatatggaaaaatatatagatatatctgaagataatagattgcaactaatagataacaaaaatagtgcaaagaaaatgctcattagtaatgatatatttatttccaattgtttaactctatcttataacggtaaatatatatgtttatctatgaaagatgaaaactataattggatgatatgtaacaatgatatgtcaaagtatttgtatttatggtcatttaaataattaataatttaattaattttaaatattataagaggtgttaaatatgccatttgttaataaacaatttaattatagagatcctgtaaatggtgttgatattgcttatataaaaattccaaatgcaggacaaatgcaaccagtaaaagcttttaaaattcatgaaggagtatgggttattccagaaagggatacctttacaaatcctgaagaaggagatttaaatccaccaccagaagcaaaacaagttccagtctcatattatgattcaacatatttaagtacagataatgaaaaagataattatttaaagggagttataaaattatttgacagaatttattcaactgggcttggaagaatgttgttatcattcatagtaaagggaataccattttggggtggaagtacaatagatacagaattaaaagttattgatactaattgtattaatgtaatagaaccaggtggtagttatagatcagaagagcttaatctagtaataacaggaccctcagctgatattatacagtttgaatgtaaaagttttggacatgacgtttttaatcttacgcgaaatggttatggttctactcaatacattagatttagcccagattttacatttggttttgaggagtcacttgaagttgatacaaatcctcttttaggtgcaggcacatttgctacagatccagcggtaacattagcacatgaacttatacatgctgcacatagattatatggaatagcaattaatccaaatagggttttaaaagtaaagactaatgcctattatgaaatgagtgggttagaagtaagctttgaggaacttagaacatttgggggaaatgatacaaactttatagatagtttatggcaaaaaaaatttagtagagacgcttatgataatcttcaaaatatagcacgtatacttaatgaagctaaaacaatagtaggtactactactccattacagtatatgaaaaatatttttatacggaaatatttcttatctgaagatgcatctggaaagatttcggtaaataaagcagcatttaaggaattttacagggtgttaacaaggggtttcacagagttagaatttgttaatccttttaaagtaattaacagaaaaacatatttgaattttgataaagccgtatttaggataaatatagtacctgatgaaaattacacaataaatgagggatttaatttagaaggtgcaaattctaatggtcagaatacagaaattaatagtaggaattttactagattaaaaaattttacaggattatttgaattttataagctgctatgtgtaagagggataataccttttaaaactaaatcattagatgaaggatacaataaggcattaaatgatttatgtatcaaagttaataattgggacttgttttttagtccttcagaagataattttactaatgatttagataaagtagaagaaattacagctgataccaatatagaagcagcagaagaaaatattagttcagatttaatacaacaatattatttaacttttgattttgataatgaacctgaaaatatttcaatagaaaatctttcaagtgatattataggccaattagagcctatgcctaatatagaaagatttcccaatggaaaaaagtatgagttagataaatatactatgttccattatcttcgtgctcaagaatttgaacatggtgattctagaattatcttaacaaattctgctgaagaagcattattaaagcctaatgttgcttacacatttttttcttcaaaatatgtaaagaagattaataaagccgtagaggcagttatttttttaagttgggcagaagagttagtatatgactttaccgatgaaactaatgaagtaactactatggataaaattgctgatataactataattgttccatatatagggcctgctttaaatataggtaatatggtatctaaaggagagttcgtagaagctatactatttacgggagttgttgctctgttagaatttataccagagtattccctccctgtatttggtacttttgcaattgtatcatatattgccaataaggttctaactgttcaaacaataaataatgctttaagtaaaagaaatgaaaaatgggatgaagtctataaatatacagtaacaaattggctagcaaaggttaatacacagattgatctaataagggaaaaaatgaaaaaagctttagaaaatcaggcagaagcaacaagggctataataaactatcagtataatcaatatactgaggaagagaaaaataatattaattttaatattgatgatttaagttcgaaacttaataggtctataaatagggctatgattaacataaataaatttttggatcaatgctctgtttcatatttaatgaattctatgataccttatgctgttaaacggttaaaagattttgatgctagtgttagagatgtattattaaagtatatatatgataatagaggaactttaattcttcaagtagatagattaaaagatgaagttaataatacacttagtgcagatataccttttcagctttctaaatacgtaaatgataaaaaattattatctacatttactgaatatattaagaatattgttaatacctctatattgagtatagtatataaaaaagatgatttaatagatttatctaggtatggagcaaaaataaatattggcgatagagtatattatgattcaatagataaaaatcaaattaaattaattaatttagaaagtagtacaattgaggtaattttaaaaaatgctattgtatataatagtatgtatgaaaattttagtactagcttttggataaaaattcctaagtattttagcaagataaatctaaataatgaatatacaataataaattgtatagaaaataattcaggatggaaagtatcacttaattatggtgaaataatctggactttgcaggataataagcaaaacatacaaagagtagtttttaaatacagtcaaatggttaatatatcagattatataaacagatggatgtttgtaactatcactaataatagactaactaaatctaaaatttatataaatggaagattaatagatcaaaaaccaatttcaaatttgggtaatattcatgctagtaataagataatgtttaaattagatggctgtagagatccacgtagatacatcatgataaaatatttcaatcttttcgataaagaattaaatgaaaaagaaatcaaagatttatatgatagtcaatcaaatccaggtattttaaaagacttttggggtaattatttacaatatgataaaccatactatatgttaaatttatttgatccaaataaatatgtcgatgtaaataatataggtattagaggttatatgtatcttaaagggcctagaggtagcgtaatgactacaaacatttatttaaattcaactttgtatatggggacaaaatttattataaaaaaatatgcttctggaaatgaagataatattgttagaaataatgatcgtgtatatattaatgtagtagttaaaaataaagaatataggttagctactaatgcatcacaggcaggcgtagaaaaaatactaagtgcattagaaatacctgatgtaggaaatctaagtcaagtagtagtaatgaagtcaaaagatgatcaaggaataagaaataaatgcaaaatgaatttacaagataataatgggaatgatataggctttgtaggatttcatttgtatgataatatagctaaactagtagcaagtaattggtataatagacaagtgggaaaagctagtaggactttcggttgttcatgggagtttattcctgtagatgatggatggggagaaagttcactgtaattaatctcaaactatatgaacctgtcaagaattttgtataaacattcataaaaatttttaaattaatatgtttaagaataactagatatgagtattgtttgaactgccacctgtcaaatagacaggtaaaaaataaaaattaagatactatggtctgatttcgatattctatcggagtcagaccttttaacttctcttgtatcctttttgtattgcaaaactttatgtattcatcaattgcaagctgcaattcgtcaaaattatgaaattttctgagataatgcatttctgattttataattccccaaaattcttccatagaaccattatcaatacatcttttttaggaacccattctccatctgcaaacgtttattttctgtttcaagcaattttatttttgcagcaagtttttcggcctctgttacttcttctgaagtctttctttttccccgtctatcgacaagagcttctgtgccactttgtttgtatttaactgtccaagaataaacctgttaatatgaaactttatatttcgcagctgctagctgataattttcattattttctatgcagaatgatattatttcaactctttcttcataacttgtttttcttcctttggtaaattaatacttaagctagtcaaccgagcttaataggaatactcctacaagcctacgaatttattcgtgggttagttgactcttcatttataaacttttccacgtaacaccacacaacactcattttagtagttttaaatttcctaagtatcgtactaatggaaggtaaatttttattaatactaacttctggattggtaagttttctattacaagctttatattcttgtattaataaatttaatactttctcttttgtatatttttctttattttgtagatcaatatcaaattttaatattttatttgcttctttttttaaagcatacatagaaccaaaacgaattataaatacatcagcattgtaaatatctttcgagttatctaattctccattactagctaacctgcctagtttttcgctaaattctatatacatttctaataattttttagtatctacttctactattacagggctttcattaggaggttcgaatccaatttcttttagtgcattattatagttacctaatactggttcaaatgatttagtgctgcaacagatttcttcaaatttatttgaaccaggtatataccctaaatcatttacaacatcttttataatttttatccattcttctttggtccttcgttcatttataatttcatgtatccctgcaagtttttttagttcattccatgtttcattaaacctgtttctataataagtaaatgaaggtatatttgagctcttttctttttcaaattgagctttacttatagggtttattttataatattcttctttaaatatttttaataaatattcatctgtatattcatcatagggagatggtcggtctgatgttttaacatctaaaatatattctacaacctcgctccatttcattttgaatttttctctatatgtttttggatcaggaagattttcattatttgcaaacgtatttacagatggtattattttattttctttataccaatctttcattatttttattagctcatctttagtataacttttaggaatactaacttctaatcccagtttgcttaaggctttattccatttaccttctccaaatctttgagctattgcagagccatgaggtgatacttctcgtcgttttggtgtccttcctaactctttttgtttgtttaatacaatagtctttaaatattcatcagtgtatttattcttcattcaataccacctaatttctattttttcttattactatttttgatgcgtcaaaactagccacaattcccctattgttttcagttatattcattttctggacccatctaaggatacagaaatttatatattttttaatcatagttatttatatatagaaatgtaacttaaactactataaatactatatattattaattgaactattccacttggatctaatcacttattcatctgtatatttatttcttctattttactttttaatgacttaatcttcaatttattaattaattcatctataatgatgattgcacccaaaataatagcaattatcattgtattaaagaaacttttaccattcagaataagtataaataataataataaatcaaatagcaaaggtattaataaaaatctgaaattatatttttgcataaagctgatttctttagttaaagcaaaaccctcattcacatatatttcttttaatttcttttctattatctttgaatctacttccgctccaatctcaattaattcttttataatatcttctttatttatcacttctatcacctctaattaataactatgtaagatatataaacataataggtataagtattattaatataactacaccagttataactttattcaaagccaattttgatttatatttactctgttcatctttagaacatttaattattttagtatgttttataatgttatagataattgctagaatagaaactatagaaataattaaaagtataagttttctatctccaagtagaaaaatatatatgaaacctactaatgtaacaatgcttaatggaaacattatcaaattcttaattatactattattattcagtgtactctcacctctcttatttttctattttaatattcactcttcctcaattctttcaagatcatgcatctaatatttgtattacaaattagttatattctcttaaaatacattcaacttctactatttttatatcagattcttctctcattacttttgtgtatggttgttcccaataccccaaaacttcttgttcagtattgaacctaattgcttctccgatgctgtcagtatcacctttcatatagtttgaatttaaaaatttaccattccttatcaatgtataaaaatactttttattcatttcaaacactcctttattacgcaatatattcagatcctgcagctactctttggtttgcgaattatcatttagttgcttgtttaattattttaaggatctcttcatcattcaatgtagaaattgatgattttattttataaaataattgttgggtactcttttctcttttttctataactgtcttttttaataatttcatacccctacaaatactgtatgtttctcgtataagaaaaccaataagaatacttataataatacaatgataaattaatacataattagggtttattttatttaatactgttgatgtatcttgtgtgaaaatcattattattgttattacacaaaccatttgaataatactttttattttcataacagaattttctcctttcattcttgacaatattttcaatagttggttctatcaaaggttaatgatagaaccataattttcttaaaatacgtaacatataattactattcctttcataatttaatttttaaaaattaagacatattaattccaaaatgtgtaatttattaaaagcatcaatttgattgccttaatcctaactttctataatctaaaattcatatttataacaggattcttttttaagtatttaaagcatctttttgcaaattcgctttcttttctatcttcatttgaacatatggtatatgatcctacatcaatataattatgctgctgaaattctagtatttcttttgttttaacatcttttaataaaattttagcatgataatcatttcttcttgtatcttcatcaaatggtgtattccaatttttaattgaaataatctctatgctatttcttaaactaatttcttcattaagtatatctattacaatatctgttacatcttcattgttttttttattttcaaatagttgcttgtttgattttatactagctaaatgtctaatatatacaaatttatcataaaagcattctctataatttaatagattttctgaaatatctattggatatgtatatccattcattttgatattttccatatatacatcaatatcgtgtatatttactccagaatgtttctctactcttaataaacattttattttgatttctttattaattatcttttttaagaattcatttttcttttcctcaaatatcatatctacagtttttttatcattcatatttattttcattttcggtacaaaaattctaccatctgaatattcttcaatatgtttacctaaaccttcttttcttaaaattctagccacattttctatactttctttatcttcaaatgttatatatgaaacttttttcccacaaaagaaactttccattatttttgctattcctatattttcattcttataactcacataaattttaaaatcatcaaatttgttctttacttcacaattaaatttaatattacttcctgcaataaattcgtacatcttacttattcccttcttttcattataataagttttatacgttaatacttccaatctttatataaagatttttcatctttatctggaacattccaatatgctcgaacttctggcaaatgaactagccaagtcttccctaacttttttgtgtttaataatttttcccgctgacaagcctgctttattgctgatactgttattcctgtgtattcttgtgcttgtgttgtccctacaaaacctgtttccataaaaaacaatctttttattactgaatcatctagcttattttcctcctcattaaaatttccattccaaaatttataatcttttattttagaattacaaatttgttcttgcaacttatttatttcatcttttaaatatacaatattactatttttatctatcttattttttaagtaattcgtagcctttaaaactgtaaggttctgtgagtgtactccaagaggctctgttaactgtcccatattttttacttttattattcctcttctttccatctctctaatgtataagatatttaatttcatcaatttttcaactaattccatatcaacttcctggttatgtaaatcgcaacaaaccataacctctcctttcacttttttattttacgattttttaaaaccaatatattttattaaatctccataacatcttacaagatttaactccatatctttttaatatctttccttcggttgtagctatattgcattgtctctttttatgatataaagctgtaatataacctatataactttcaccatttacctttgtatatttaattaaatccctatgtttaaatcctaagcactctttgatatttgccttagattttcttctcataggttttataatccaatcttttatagtacaattatcactattaattattaaatcagttattactaaagcatcattagaatgacttttatctatattccaatctattcttttatttgcagtatcgccacctgttgttaaaattaattttcctaatttgcttaactcgtttcgtaaataagttttaccctgcataacgtgttgagcataagactgaaggttatatctaaaggtatgtctttaacttttctacaatcatagttcattatgctaagatattttcatatctctacactcacttaggcttgaaaacatcaaatagttataataacttacctaaaagctacgatatgttattatttttagcaactatttgaagttcctattgctctacataagttccatatactttattatatattctactggtattctcaaaaattatatctatccaaggattaaatcctccattatgaagataaatttctcttatattattccaattaggcttttttacaaaattaaaatattcatctaattcttctaaaatatactcaacccactcttggtcatcctcatgccacacatcaattttttagttttattttcaatactcatatttgttattcctaacatttttatttattcgatatcgaatatgcttaattatattatagtcgatatcgtctaaaatataaagagcttttaaagagaactttccgacaattttcgtatttctatatttaaaataaatgaatgtatgattataatcaaaatcatacattcatttattttaattgtttactttattttttaattttaaagtttatgcaaaaacaagaacaatatttttaaacaaggtttaatcagaatattattcttgttatttttagttccatttatctttgtagtaaagtttaatcagaataataagattatgtttaagttatttgcaattttcattataccactcttccatactaacatttattatattaccttcataatatttcacccaatcactaccaatataactgctaaatagtgcttgattatcctcattgagattatcataaataacctccgaaatgatgattgtctttctcaaatttcgacctgctttattacaaatatggcatgctgaattaacgacatcccccatccatataatatcattaatactgctaccagaatatccggctttaaccattaacgctctgccatcatcaattccaattccaacagcaatctcagaataaccctttttatttaatttataatttaaaattttaatcatactactaagtttagctgctacgctaactaccgtatctacatccactttcttaggtgtatcaaatactccccaaacacaatctccattaatacttatttctttacaaattgactctgaattcataatagccacacactcagaaataaaacatctatacattttggcaagtgttggtcttttatgtacatctgtcatatctgatgaacctactatatctataaatagcgctgtaacattaacataatatccatttgtataagttaaagaacttcttgaaggtacactatctttatcaacaaaatttgaattatttgtatctaaaatatcatccatcctatttgaacctttttccacatcatataacatagtactttttgactccatatatccacctctaaactaattgaaataccatacatataaaacataaaattactgtaacgattaaaaataataatcctttattgtaataactaatttttttactacatattttagaattgatatgtatttgttcccctaaatcatttaatatttcatcttctgtcatattattaattttttctatatatgctaccctatccatacctcctatagatccaaagaaaaaaattgattgattgttagatatatcttttactttacctttaattccaaacaaaaaaaatataattgatattaagcttgtacaatataatgataatactattaaaatacctaaaatatctatacctttcaattctaacaattttttatctgcaacattttgaaaactattaggtaatcctttagtaaaaataaatcctattaatacagccataaaagctaaaacaaaagatatctttgtatctatattccctatccataaattaattatttctaatgttttatacgcatcttctctattataattgctttgttgactcattttaatatcctcttatctttataattttctctaccctttttattcttttggaacaaataattttttaaccatatgcttctcctttcaattaaatttctttataataagtttcaataaaaatattactatattaattataccaaatttgttaaatttattataattctatctcttttaaatatttatatctatccatatcttctaaaactatatttataataatactagaatttcctagctactattttaatgaatgtatgatttcatctaaaatcatacattcattattgaaaatttttaaggatatttacacgttttttctataactataaatatcctctttttaatcttttatatttctcattatattaattcaaatgatcgtaatccacatgataataaaattatgattacaaaattaaaacttgcataagtatagactttattttttgtctgattctttaatttataaataagatctttatcttcatttaagtttaagtctaacattttaaacaaaaagaaagctatataatggagtataaatattactgatataaccataaatgatgatctcaatatttgatttatcattattgtattagataaaatattttttatctctacatttaacatatatctttcatatattatgtaagctactaatgatataataggtattaaaactatccctttacaataattaaaaatatcaattattcttggtgctggagttgttaatatatacattattggatttaacatctcttttttatttgtaattgtgctatatgaaaattcaactatatttactttattaagactaacatatctattatcctgttttattgaataactttctttattttcactttcataccacttctttattttattaaattcttctacagtagttgaaaatgaaatgtccatattgttaattaatttaaataccaaatgatatcccttaactgtattatctttaatgtattctttgatattatgtgtgattttgatatttttaaaatttgttataaatgtactgaatttattattcataatataaaagtcctccttttcaaactatattatctattttcttttctttttttaatgatgaaatattatcaatctcataactcttctttaatgtagcaatttacattagaattttttagtgctttttaaagctttcagatcttctaacttataatttggaatattacaacaactaataagcttaaaaataaaacttctccagtatttaaaccccccattaatgggaaaaaacctttaggtgttttttccttttgcaataataatgctatgtttagacactctgatgcaattaccttacaatctgacaaagtacttatatctaaattcttcaatgaattatatttttcattagtaataatatctttaatatcagaattttctttagtagattcattcaatatataaccttttaagtttcttgatactttaattacttcatcaatttcaaattctgaaggtttcaatattttggagtttcccattttatctatcttaataactaattttatacatgcttgtacttccttataatatttatttgctttttttcttttaataaaataatttattatcgattgttttacattcataatataattatcctttctttgctcattatttaaattattaattttctatttaccgaatttaaatgatgaaatattatcgattcttatatgccattccttttcaaattctgttttataattaatatgatctttaatcctattagccagatttaataattcttcttcctttgctttttctcctatttccgataatgaaaacacatttctattaaaagaataaaagtagctttctatctcaacctttaaatttttatcatcaatcaaataatatgcttcacaaatcaatgaaaaaagcatattacgatataagttgttacgcttttttatatactgtttcccatttttagatccttttaccatatcatcacaaaaatgttttattaaataatcattatatatatctttaaatgaatataaaagattatcatgattatatactggagagtttattttaatattactttcttctaacgtagttaagttacttacccattggattttatcttttgttgaacttattcctaaaacatatctttttcccaattctgtaagcttatttattacacttttatattttctgttaccaaacactttatttcatcttctttctattgtaattaatcccatatcaattatatattaatatctccgacttcatgtttcttctagctgccgcaatgttttttgtataccaaatttaatctaatcgttttagcaattttttaaaggcatatatagtgctaaaataaactgaagtactatagattggtacatacaaatacttattttaaaaaatgtaaactaattctcctttaactttttgtttatagaatcctttaaagcataatattgcataacccacatttcatctattccaagatgcatggtatataattcgtttatatataaatcaatcttaggtaataagtcctttaatttctgagcacttaaatcttctattgataagatattttctactctatttcttctaccaatattagctatttttaataatggagctacctttaaagaatctatcatttctttatcttcttctgttaaaattatatttttattatctaccatatctctggcccctttcattttaaattttattcctgaatataatttttcagctgtgtactagcaaaccaccattaatctcatttgattacccttgatttcgtaatgtcttgccattcttgtacatttaatcatttgtccacctaatgctataatcatattttcaagcattgatttattacaccttacccctatagtaatctttgtgtactcttcaccacttttattaaaaactcttgcttgatattgagttgctttcatattatctttcctttcttattctcataaaattttcaattcgcgcaatatctcttgtaatgtgacataaaaaaatactgcaccaattgaatagtgcagtataaaacttattatatttaattattaacaaaactttctataaattcatcccagggcaataatgggtattcttgtttaagcaatgccaatgtttctatccctattttggccttaccacttttcatatcagatattagttgtctactcttgtttatttttctagctatttcagattgtgtgtcttttgttaagaataaaatatcgttaaatgttaaaggttcatttttatagaatcctaaaatttgatttattactctccctggaatatcattttggtaatattccaatatttcatcaaacaaatttaatatattattaaattcttcttcttctaccaatcttgaaactgatatactgcatacatcaatatattgttttcttccaagtgtagggaaatagattcctatatctgttctatcaaattcatatatattacattttatatttttactttctaaaaatttaactaaatctccctttttaaagtaagtgtcgaccaaatcttgttttgggacacctaatattgtaaacccttttatttttttctttttcatcatttcaagcaataaattctttttaaaaactgccatctgattatcccccaatctatcttatttttaaagttgcagttcctatgccaccttttttacctaattctaaagttgcatttggataaatagctctaactttttcagcaaaatttaatatagttgcattagtagtttgttttgctgactttgcaagccctctataagtattacctaaattttcaactataccttccttttctaataattttaaaactgctttttgattttctcctaatctcataattcagtacctccaaaaggatatttatcttatatatctattgtacgatattatcgtacaatatacaatggttttataagatgtttttttacaaatatttcgacaaaaataatatacaataagttttatactacactattcaattttcaaagaacaattttttattataataatttcatttcttgatcttatattttcattgcattttaatcttttatgctttcactacattttttaaatatatcaagtatttgtaatggtgctaaattttgattcatatatgaatctctaaacgcatatttgtaccatttgatttcaaatcctgtaggcttatatacaaagttaggcagttctgcctcttctttatcatcatcccaacaataaggtcttactgtaaatacttcattatcgaaaccatagaaatctcttgacacttcaggatctccatacaaaatactaatttttgcttttttacataaagcttcccattcccttgaattaaccaactgcctgtcagggaacttaaatgctcctcttgaattaccaaataataaatttcccaactccatttttttactccttcaggccgtattattttcaatttattggcctcaccaatatgatgtgtcgtctaattttcattgtatctattcttcatcctctggagtttgtttcatttcatttattaatactttaagctcgtttaaatctctgatatagcattcaaaactccttaactgaaagccctccatttttcgtaagctccaattttcccatttagttatatcaatactttgaaatttactttttatgagttttgttattaagtctctattttttggtgtatctaataaaacatattctcttctatcttctttggcaaattcatatccttcctctatcatttgctccaaacgacttttttgttttttctcttctgtaactggtcttgttgatgcaaaacttatatgacttgcatccaaaaagaaacaacctttataaccgtagtttccaaatgcattatctgttacgagattaaatccttgtttacgccaccatctgcataatgcatcatgcatagcatataataattctttcaatccatttacttgagtgttttcagctaacatttttttaagttcatgtatctttttatttgcctttcttatatctgcatatcttgatgctattttagctgaagcttgcgaatcaaactttaaaacttttgaagcctctgctgtgtagctttcaataagattaaataatacattcttcatttcttcagttaattcattatttttcaactcattaaataattcacctgttgtattatatatatctgataacctctttaaagctattgccttttcatcatcattgagagtaactaatttttctttttctatatccatgattttcccccttaagcttacttcataataatttcaattcctggatcttattcttgtattataaaacattattttagaatttcatcaatcggcatattgttaataggacattcatcaaattctattttctttgtatttccaatgataaaatctacatcaaaaaatgaatattttccgctttgatatgctagacactttttaataaatttaattaaatatacatcagaactagtataattcttagcgaaaccagaaatgtcagctgaattattattctcatgacttatatatggaaactgcctaaattcatgaaaaaatattgttcgttttccattgtatatatagtttgctaacttattaagctcaatttctaattctgaacaatctctaaactttttaatatgctttgcaatatctgtcatatgaaaactgtcatctggcataataccaaaagcatgaaatggtgtagattctatatttttcactaatttagtataggttcctcttttaaacattcagttttaccctcctcagttaatatatttgtactatgaagtaagtgtatttaagtcataattagatttaatgaacttaattgatttttctctgttgcagtcatttcctaaataagtgtaaatctccgccatttcatcaaatgtaaattcagtacctaaaaactcatttacaatagcccttattctcttttgccaatagtcactaatgcctttacagcttggtcttgataaccaagcaagtactttacatttcaattctaattcggtttctatatcttctaacctgaaataaatattattttttggttcaatgattaactcataattgtgatttataaaacatttaggtgaatatttatgaactatatttataaaacttttagttaattctacattcatagaaaaccattcctttattaatgcacaataatttcatttctgactcttatgtcgggtaggtcagaaacctttcggcttccttcctccctaagaaccgtacaagtctctttcaaaacatacggctcaagccaccatttatcctagcaatttgtatatttaaatttcttaagttgtttttttattaatcttattccctctttgcttgatgggtctacatccatttctttaaagtacttttgtattttgggcaattctttgcctttaccatacttttttagtaattgatgatgttgaatgtgacaacttgtatgtaacaattctaagttatcatatatatctttaccaccaattgagatgggtacaatgtgattaatctctagtgattcttcgccaactaatgattgattacaaactctacatttatacttgcatttcttagctaatttgcgtctacttaaaatattatgtctattgaactctttttcatctcttactttaaaatagtcctttaaactagggtcatctgggctatttttatatttaattaatacatgtcttactataggtatccaattcatttttattaactgatttttgttattattagggtctgtaagtatccatttatctttacttactcccgtaaaatcaggtttgaagtaccttttgattctccatttccatggtttattcgggtgaagtaccttaaggtattttcttatctttagccatacatagtggtctatgctactataggtatctttcgatactacacaagaccagtaatttcctgtacctcttattattggattaattttacctataattacttcaactgaattacctctgtatctttcaaagacttccttaattgactttttagcttttttcatacttgctttagatggtttaattagtagcgtcatgcccttaattttcttgtattgccttatattgaatccaagaaagtcaaatcccttactaatatgagttattcccgttttatcttctgcaagttccaagccccttttcttaagataaggactaagtctctcgtacattgtttctgcctcttctttggtcttacataagataacaaaatcatcagcatatttcacaatacctatggaattatcccttaaacaatatccttgccttttagtaaactgatatttaactcctagttcttcttccattccatgtaatgcaatattagctagtaacggtgaaattattccaccttgcggtgtcccttcgttagtatttctaaagacattattatcaatatatcctgccttaagccatctatatactgcttctttagctgggaagtcatttatacattccataatatattcatggtttaggttatcaaagcaacctttgaaatcgccctcaaaaatccactgacgtttactgcctttcctcaattttaaatacagttgttctattgcgtcatgtgtacttctttttggtctaaatccatatgctatggattcaaatttactctcccattgaggttcaagagcatttttaacaatattttgatatatcctatctttaattattggtattcccaagggtcttaatttaccatttttcttagggatatatgttcttttagcaggctgtgatttaatgtttttgatactgtaatctttaagtgagttaaatagtttaattctatcccattcagtaattactttaaatccatcaattcctgctgtacgtttccctttgttaatttgtgtcactcttttaatcgagattaacagattagccttgcttctcaacattagtctttgtagtttcttaacctttcttttttgacctaactgctcggcacgaaaaatccgttggcgtaatctcttcacatatttatttattttcttccagttaagtgtgtaccactctgcgatatgtggagaagtagccgacttattaaatttattaatagtttccataactaaactcctcttttgtaattgattacttttcgtttaatttcgtgttgatgaccatgtagaagtctgcaccctttcgggttagagcaaattttgaactcctatccaacgagttatttatttctctagactttcgtcttattggctttcgctttctccacattcccttaccctctatacattgtgattctcttgcgattatcctaccattaattggagtatatagggcttaccaagttccactaataatagatacgaatgagttaagtatccttatatattccgatggatatatgggtcactcctcgattggtcaaacaaacaacctttcctatccataatataagcctatcaaccacctttggcttaacttcgcatgacgaaaattacaaaggttcaacataagtttatacattctcattcttcctctagccttgtagaatattgtggttatattctacattagacctttaactctcatgcaacccacatttcgattactcaaaatgcagttttgagcgaagatatgcttagcgactagcacagtttcttatcgaaacactattatttagcgacttcttgtcgcacatttgaaatgtgacttaatctgcttcacttattgaattataaaaatagcttcctttaactacataagcatcttgtaaccaaataataattttaaattcattttcttttattttttcaactggcttaatattatcagtacagtataatcctccatctataagtaatatagtattacttaatacttccatattttcatatacctctactgtttttataatgtcattgccacctactccttgtaattcaaattgaactatagagccttcaggtattataaacttattatccattttaaacctccctatttagcatagatttcattcatagatttaatttttgaattacgaattaattttctttaacaaattctaattttaatctttctattattaaatcttttatttgatccatacctaatgccattactggatttatttgttttgctgattccatttctttatctattattttaattgcttcttctaatccttctttcataatatcaattcctttcttcacatttatttcattcctggatctaatatttgtattacgcattaagtgatcctggattattgtatatatttcctataacttcacagttataaagtatatcttcatctgcattactttcccaatgaagttggcataatggataaacatcgtcattccaacagttatcaaattctgcatacatatccgtttcatctgaacatcttactaacataaaacttccgatttcaaatttaatgaaatatataaagtcacctatttcaactatatctccctcataaatttctttgtaattcttatctttaaaacctgtatattgtcctaccgattctatatctacagttttaacaaacttccatttaaattcaccttgctcaatctgtattccataattaccttttacatttttgcataaattgccataaatccattctccatttgcagtatcacatccacgatatttagtttctctcataaaacttgcctccttcgccttaatttcagatcctgcggttgctatttgaatgatgaagtatttataaatcccaacgttctttgatattatttaacacttcatcattgtctggcagtcgaaccaagttatccatatcgtaataacctaattcaaaatattcttgaatatattcaattaatatttcaagtgccattctattacatggatttttaagtaatttcattagtctttcatcatcataatcatggctttgacatggtccatatgttgaatgaatataattaaaatcttttagtgcttgttttcttaattctaaagccttatttttctccataaatatgcctcctttgatactgcgtaatgatttcaaattgtatattaattttaatcaaaacaaattttaatatttattttagatagatttgaataaattaatttatatatttgatttttaaaagttccctgtatagttatttgatatttctggtcttctttaatattaccttctgaatccttttcatattctgaatacacactattcttaacttcttctattaaaaatcctttaggtagtttaatcttctcactaaaatagctttctgaaactaactgtatatcgtcaaatccatccatcacatactctgcagttttgaatttattaataaagtcgttatcaaatttacttaaagcctcttcaatattaagaaatagaaccgaattactagcacttatttttatattcatttaaggcacctcctttatacttaatttattcagctcttgcaacccctctttgaatcacgtcctaattattatctatttcaatcgtttcttcatcactaacttatatttatattatgaattaattactcgctgataaagttaattgctccccggtttctccttcagtaatcttatctgaaatactgaatttttctccatcttcttttccttgataataagcttcactatatccttgaaatgttgtattcgtatcaatacttcctttaaaattaatgttattataggcttctacaacttcagcatctttaacaagtactaacccccattcctggttcttatttttttgttcttcaaacattttttccaaaccatttataaagcctagtgcataatcactttctaaaccttttgtgctatatccatccttataatattgatacctcattttttttacagcactaagaatacaatcaactgcatattctaatacaatattacataccaatatatcttcttccttaccaaagaaagctatagtcctagaagtgcctcttctaaaatattgatagcatccaaagttttcagctattatatctcctaacttcgctttccatttaccttgtctgaaagaaatattacttaccttctctttaatagaagtattatttatcttatattctttaacttcttttattgataatttatgtttaacaagtagctcttgggcttttaacatagctacttttgcttcattttcattactactttcacttaaagctaataattttttaattttctctattaattttacatccaaaattttcacacctttacatcatatttaaattactaattaactttaatacctattaattgttcacaaaataatcatttctccaagccctgaaataatagtcatcataccattgcctaatatatacaaattctaaccatcttgtttcactttttatagtcaatgggaatattagaaactttcttattgttcttatctcatgatgctgaggttttttccatttcatattttattaccatccttaaatacataataatttcattcctccacgtttatttctttatcctccaaagttcataataatttcagttagaagcggcagtattactgttcctatgacctcttaatttttgaatcgtgaattaattaaaatttgccatttaggaaatcgcctttgatctcataataagtatatcttgaactaactttagtaggctttttagcatataattttattgctatagcaggtatagaatctaagtatttattagaaattttaaatctagtccataattcattatcctttttaaataatttcatttccattcaattcgctcctttactttaaattcaaaatatatattaatattcaccttcggatgattccatcaaacacacgctagatgctccattagtacctacccttgtacacatttatactctcattatgaacagcctttaccctggcttcccattatatctatagagaaatttgtggttatgttttttatttttttattttttaccataagcgataccacctttttactaatataatttaaagaattagtaaatacaataacactttggctttatttgtattagacatatagcaatatttctgaaaacaaaaaacacgatatattctcttaatataccgtgttaaagaaaattattattaatctaaattttaataaaacactgttcttttgcctatttttttattattaatctaaaaatttccatatgcatcaacatttatatatgcacgtgacatacaatgcttatacatgtaaataccatcttgtatacccatgaacattaaattatcccaatatctttttgggatatatctttacataggttcaaattctcccaactattcattgtccttatttaaatcttcctcatttaatttaaatttattttcaatattttttatgatagtgtttatttttctttttatcattttaattccccctcaattttagttatattaaccatgtgatactctttagttaattattattgcaaataaaaaaatagtatattaaaaaatatactatgctgaaaaattttgtaatgcatcataaagataatattagttaatactcatcctctttatattgactttctaactaaacctcaaaattaatacttgaattattacctaaatattgttcaagcgctgataaaagatcttctaactcatttttattttttttcttaagtaaatcaccaaaagaaagcagtgttggtatattatctgggttataatctatatataattctttaagatatctattaatcaaatatcttttcggcttagataagtctttttcatatatacattctattaactctataatcgtattaaatctagtattcatattttctaactctatattagaatttaattcaaaaggattgaatgtaaatgcctcattagaattaatttgtattatttctactcctaacatttctgatgaatgcttatattcatctattggatctacaataattgggtttagttttactcctaaatattctcttaatacctgttctcttcctctcaaatattctcttaatgcctgttctttttctttagctcctttttcaacactttttttcatatttacatttctccttcataatttatttacaataatgtccataacatttttgcttattaactatattttcttgttctctaacttcttttaaatctctaatttcttgctctaattctcctcttgtcttttgccataaagtcttatctagttttagatatatttcacctttttcattgtcattaagtaactcaattaggtctaatacactattttttagttttttcatcttaacctccaatacatcatattgtttttgaattgcatactatagcaattaatatttccacatattttcctatgcacctttactaattcctttcttctacaaaatgcaagccttgttttgaccatttaagtaatttttcagcataccaaataatttcttctttctgcttatcgaatgtaccgtactgcttttcatcagtattatataaataccaatcatgaccatcaatcaaaggattttcattcttatgtaattgatttatattattaatcatagcttctaggccccttataaataaaccactatctgttaatatcatctcattctcatgcacttcataggcatcatctaaccaatcatacataggtatatctatttccattcctatcaaatactctgcatattgtagtgcactatgtatataatgccaatttcctagagcaatgtcataatcttcatcatcttcataatgaatttcatagttttctcccatatcgattttcactttatatgacttaaaagcatgtaaagtcctactcattttatcaatcctcctttattataaggttcacaataatttcagatcttgcaactactctttgaattgtaatattatagcataaaactatcatgtccaaattgttctagctcatttttataaatttcgagttcatcatcagataaaaaaccaattttattatatagttcagcagtatacaaacttatcctaaaaggattttgtatatttaataaatatacttttgccatatcaaactgacatttattcaataccattataggattttccatgctatttttaggtagttcatttacttcttctcttgataaatctttcctgtttaatttgtaaattttctcattgataataacatatattgtatgagtattaaaaaatctatgaaattgcatctccatatttaatcccttccttaaagttagttgataataatttgattcttggaccttatcttttaaagacgaattatcatatttatttcttatatactggttttaaattctagactattcgttcattttctttttttacaaagtcccaaattaaaactagctttatattttttttatttttagctttatttgcataagatattgcatcaacataatttaaaaaatatcttttctttgttctttctttgaaaaacgaacgtcttatacaatatataacagcatatcctaattctattgaattccattctttatcccttattattttaccttctatctccattataatttcaatcctttctactctatatagtccgcattaatttcatttatggatttaatctttatgttctgaaactcccaagcctaaaggcatggggttcttaggtactatataacttctatattatctccgaaagtataatatcactaattattttccctaagactttcactatcaaagattgctaccaatctattaacgatagtataacgcccatttcaagacgttttaataacttgtataccaatactacttagattattttttaatccttgtaatctcaatatttctttattgtgctatccatcccacacctaaaggagtgggctttccgcacagttttgtaaatctaatccttgaattgcaattttaattaatatcactttccttatttagccactcaattgtactaatcaaacatttgttgcgttgttctattttacaagttggtgctttaggacaatgtgtacagttttcccatactaactgttttgccatatcttcttgacttctaattaatctttcaaaatttgtcatacaagcaaacctccttcccttaagttaaacaatatattccgcttttctcgcctcaataaattcattttcccaaaactcatctttttgtttttctaatttattatctaatacaacatctacaggcccatcaattaaattaaaatagttgatataggtatcatccctagtgtctttaatccaatccatagtaatgatacatttgttattctcttgtacagaataatttaataacgaatagtaaaccttgaatccctctttagtttctaattctattgtttttttacttaaatcatcaataatttctaataataaatttttctctttcttctgttcattcaaatctattatagctatatttaaaaaatcatctttttttataggtaaaataaaatctataagttcatttaatactttgttttgcatttttcctataagggaaaaatctatatctatttcatttattatagtgtacacacctttcttttttttgctttttttaggtttgacacccctaaatattggaatataaacatctttaaatatagtatccttttgggccccttctagtactttaatatcaccaactatatacttattaccattaatattacttcttgaatttattttatttatttcacatttaatatttgatcctaattgaatatttagttctgcaacataattagataagattatttgtccttcttttatcatacttttcacatacctttcaaatctatttattatatatactagtttttttgaaatttttcacaataaaaaagtacgatttttttaaaacaaaataataaataaatacaaataaagattatggcttttaaaagctaacataaggggaggatttaaaatgaatatgacttcattattaggcagaattgccactaatttcgaggtaaaacaagtaaacaatacgtcagttactaattttatattagcagttgacactacaagaaaaaataaagaaggaaatggatatgaatgtgcatttcttcctatcgttatttttgggaaaaatgctgaaaatacttataaacatatggccaaaggtgacacagtttgcgttactggtgaattacgaagccggacgtataaaaaaaatggaacagatgtaatggttatagaagttatagctagacaaatagaatttgttagaaaatccaaagcaaatcaacaacaattacaagatggttataataatcaacaacaatcacaaaatcaaggtggatataataatccacaattaacaaatcaaggtggatataacaatcaacaactacaaaatcaaactggatataatagtccagaattaataaatcaaggtggatataacaatcaacaactacaaaatcaaggtggatataatcaaccaatacagccacaataccaaagttttaatagctttgatgatgatctaataccacgaatagctgacggagatataccattttaaaaattaagaaataaaaaataattagtatataaaaatattgtgtaatacattcaaagttattacacaatattttttgtaaaatttaaggaggaatcataaatgaacataaaagttaatggtggagaattcaaaaaatatataggattggcattaaaatctacagcatccagtgctgtcaatgccaatgatataattaatattagtaccgataatagtaacctaattatattatctggatcaagtgattttacattaaaacaaaagttaagtaatgtaataatttcagaagaaggtaatataaatattagcgttaccatattaaatgctattattaaaaaaatgactaatgaagaaatatcattatttatagatcctaaaaataatgatgttttaaaaataaagcaaggtagaaataattcaaaaattgctcttgcaaaagagcatactatatcagatattttaaaatctgatataatatatagtttaaatcttgatgcaaaagtatttaaaagcttaatagacactacttcttatgcagttgcacaagatgaatcaaggcctatcctattaggccaatacattgaattagaaaagaatttaatcaaaattactgcactagatggatttagattagtttctaatagtgcaaaaatagaaaatcaacatgaagatatgatattaattcatgcaaataacctaagaaatctgtcatcattaattgatgacagcacagaagaggttatattaaataaaaataataataaagcaatagtagaagttaaaaataaaaactatgtagctattgctgcttctaatattttttcagaagagtttattgaatataagcagcttataggggacttgtcatcatttcctataaaaataaccgtagatagattacaattattaaatactgtagatagaatttctgtagtttctagtttcgttaaagaaggtactcatatcttaatgaaactaaataaagactcactagaaattgatggcaacagctctgttgcatcaatgaaaggtgaagtaaatattataaataacaattttcaagaagaatttacaataggatttaatcctaagtacattcttgatgctttaaaaaatataaacacaaaagaaatagatatatttttcaatagcaatgtatctcctgttattataataaacaagccagaaaaagcagaggatattagtgtaaatgcattagtccttccagttaaaactattagttaaaatttcaatataaaagatccaactatatttaatatagttggattttttattatacctcaggaacagaggtcgtttaatttatatacaaagccttataaagtaaaaacattttatatctatatatttatatatatctatcttttagttagggtttaaaatttgtaccctatagaagtaaactgtactctataaaataacatagcctttgtatatatctaggataatctatgccttttatgtaaaattatattctttctttgtattttttgatattttaccttattataataatatagtataatttttcttgaaattcatacgaaaaatattttataagaaataataattaattatataaaaatatatggctaataaaagctaaaatttaaactaggaggagaaaataatatgttaagcaaaaaaactaaaaaacttataacatcagcaatattaagtttaacaatatctctatcatttttggggactagcataacagaagtaaaggcttttgatagaacaaaagctgtttacgaattaaaaaatgctagaacgtatgaatatacttggagttatgatatatctatcaacagagatgttgattatgcaagaggtgaaatatatttaggttcaataagttctacagcacatcaattagatacaacaccatttagagttactatgaacggagagcctctaaagatatttaatagcactaaaaattcactaggagaaaaagaaaaagaactactagataaagagaaagataattcttataataaaaacaaaacattcggaatttggcaacaagagttagatggaaactttagattatatgtgtatgttattaatgctacttctggttttaacaaaacattaaaaataactaaggaatttatatctggtgatctagattatggattatataataaagatactaaagaatttagtgataaattaaaagaagttttaaattcttcatatgataaatcagatctattaaaaatttataaatatgatattgatccacgagatggaacaagcaaaattccttatcatgaaaaggaaatcatagatgaaactaaaagggttactaaagattgtacaaatgatatggaaaaagttcaggcaatatacaaatttgttgtaaaacatatggagtatgttgaggaccctgcatataggaataaaggtgctttatcagccttaaaatctggtaaaggtgtgtgcgaagattacgcttccctatttatagctatgtgtcgagaagtaaatattcctgctagatatgtgcatggactaactggtgctactggtaatcatggttgggcagaattttacttaccttattatggttggattatagccgaacctacagtgtcaagcctcagaactgccaatgaagacactttgcagaaggctatgatgacctttataggcacttatgatactaacaatgattttataccttctcactctgtagcaggttataataataatgaagatagatatcacgctatctttgatagaataaaagtgactaatcaaaatagaataataaccataaaaggtgaacctataaaaagtgtagtatataatcaacctttttctaactatcaagaaagaatagattcagtgaataaattattagaaattgccaagaatactaaaaaagaagaagatataaaggaagctagagaactagcacaaactttaattgatagtgaagaaagagaaaatacattaaaacaactaagttatataggtaaaagtgacgaattaaaatctcaaataggtgaacttgtggtggcactagaaaatagtgatacaatagatactaataaatttgaggaattaaaagaaatattaaataatgcacctgaagaaatcgtatcagaattcaaaacagcatatgataaagtacaaaaaagatatgaaatagaaaatcttattaaagaaacagaaggaaatttaacagaagaaaatttagacaaactaagtaatcttcttgataatacaaatatagaagataaatataaacttagctatatatccaaatatgataagcttcttaatgactacacaaaaaaagtagaagaacaagaacaagctaaatatcaggctaaattacaagctgctacaaaagcagttgaaaaagctgaaactagcaaaaatcaaactgatgttgataatgctagaggcttagctaatagcttaaaagctactgataaatctaacttaaatgctagattagatgaaatacaaaaaactattgatgataaaaaaacagaagaagaaaagcaagctgaatatcaagctaaattacaagttgctacaaaagcagtcgaaaaagctgaagccagcaaaaatcaagctgatgttgataatgctaaaatattagttaatagtttaaaagatactgataaatctaacttaaatgctaggttagatgaagtacaaaaagctattgatgcaaaaaaaacagaagaagaaaagcaagctgaatatgaagctaaagttcaaactgctataaaagcagttgaaaaagctgaaaaaactactatatatgaggattatataagtgctacaaaattagtatcaaaattacaaatttcagaaattcaaacacaattatgggataggctacgtgaagttaaagttgatataggtagaaaggaagaagctacagaactagtaaaattagctgaagaagataatacagaaacaaattacaatagggctttagaatctataaatagattaagagataatgaacttaagcaagatctactaaatagacttaataacgttaaatctaatatagataacaataatgcaaaaaaagaagaggttaataaattagtagcacaagcagaaaaagacaataaagaagaaacttataataaagctttagctgctgtacaatcactagaagatgatcaacttaagaaagaattattaactagacttaataatgttaaatctataatagataacaactctaaaaaagaggatgttactaaactagtagagcaggcagaacaagataataaagaagaaacttataataaagccttaactgctgtaaaggcactggaagatagccaagctaaaaaagatttattgaataggcttgataaagttaaagttaatatagataaaataaaaacaaatgaagcaatccgattagttgaatatgctgaaaaatatccttctataagtacttataataatgcaaaagatacagttaattctataaatgatagcaatacaaaaacagagttattaaatagattgaaaaatgttgaaataaaaatagaaaaactagatgaaaaaacaaaaacacatcaatttacagactatgtagataacttagttagagaagctgaaaaattatgcacagaagatgcttataaaaaggcattagaacaagcacagaaaatagaagacgttcaaagcagaaaagtttatattaatagattaaatgaagtaaaaaataatatagacataagtaaagagacagaaacatctcctattaaaactgaattggataatctagagcatgctataaacagtataaatactgtaaataaaaatgatatacttgcaataaaagaaaaaataaatgatttaaaaaatacaaaagaaagacaggatttaatagataaattaaataatatagaaaacaaatataataaattaattaataatcctaattataataaattaatcaaatacaatacttggaataacattgtatataaagaatctaaagataaaacttttgctgttaaatttaataaaaatcttaattctaataacataagtgaaaatttatatctacttgatgttgataataattttgaaaaaatccacactactattaatataaaaggtgaaactgcttatattactgctgataaattatctccagggaaaaaatatatattagtagtttcagatcaaataaaagatagtagaaataaagatttaaaacaaggtttaaaaacatttatacaaattatagaatagaaataaaaggacttaggcatttttacatgtctaagtctttttttaaatataatattcttctataatattaataccttcttgtattttttaactaagatactacttttataaaattcgtaaacatatgctttagttcgattactttatgattcatattatacttacagtcatattcatgatgaatactattaatatgtttaattagtccacatttattttgaatatttatattttgattttgaatatcttctattttcttgacatttttatcaatttccatttccctaattataaaacctagcatataattcttaccataatatgaactataatgaggaggattcacaacaaatcttgaaattccatttataacatattcctcatttaattttttatttccatctaatcttttacattcaacaaaatatgcagcctttggattggaaaaccattcattttgacctactatttttatatcaaccctaccaatatatttagaatctttattattatagttttccggacactctggcataaaatgaaatttcatcatatcattattctttctattaattgtatcatctaaataacattctaataaatgatctcttaatctattttcattattctgaatcttattatcttcattttcaaaatttttactcattttatcacagcaccataaaatatattccccaattttctgaaaaacatcattctttaccaatgaattaagctttatatctccaaaccccgccatccttattcctccgaatcatctgaaataatagtttcaagaaccattgattgatcaatatgtgacatcgcaggatgccaattcttatattcattacttttaataataaagaaagaattattcttaaaatataaaacatcttttaatttataaaactgttcattaattttattaattagaaatcgtgataatatttctttattactatcaatagtatctataattgtaatttccttttcctcttgatcacatatttcaagttcaaatattgcaaactttccaacaacttttggatataatgatattttaataaacttattttgttcagccataagctttttccagtaatccacaaaaacttttgaataatcttttagttcctctgctgtaacttcacgaaaagtcagctttttactgtttaaaagaggaatttgtacatttatagcataatcaataaacggatcttcctttaatccaaatttatctaatattagctgatctaactcgctaatatcttgacttatatcttgataaaaaccattttttaggttagaatttttcttttgtattatttcgaccttactactaatctcttcatcataagcaaatggatattcataaacttctttcataaatacttgttctctttcaatgcccattgatgatccaagcattaagtttaaatatgcgtacaatgatgaattaaatattcctgttatatttaacagtaaattcttttgactttcatcacctttaatcgcagaaatagcttccttaaaaataacatcttcttctgtatatgcagctcttaatctataatttttgcaattagggccttttcttaataaacaatatggtggagagaatatctcctttttacccaatctatatatttttcttttattaaaaatactactatttgaactattaaaatataatgtatcaatggcagtagattcaatcatatttttcccaatataatccttagcatcatacttaccattagtatcagttattccagctccagtctttaacttattttcatttattacatctttaattttaggaaattttcttttaagcattgttataatatctatatcccaactatttccatagacacatgtcttccatgcccaatcatacctatataatatatcttgttgaatattttttatatcggtcttttcaattgcaataacatgataaattttaaaaaacatatttggtttcaaacttaagtgaagcattttatgacttaaacaattttccgttgaatttttaaacataagtattgctgctggtgcatcagcttttttaaatattaaacttctgacagatgataattccactatttgcagaatcttacacttaagtaacagcaattttctaaattcaattgcaggttttttttgattataaaacagcttagaaggaactatcaaacaacaaatagtatcttcattagaatactcttttacctttgcaataaaacttctacttatttcttgcctatattggggaatcttattttcatcacaatattgtgaatgtaacccttcctttacggagccccatggcggatttcctaaaataaactgaaattttattttcttaagagctattaatttttcatcatcaaaaaaatcactaacccataaattcttattctttaaatttggtagtctaaaatcatctaatgattttggatctttgtaatcaaataacgttaaatataatgaaaatattgtaacatcaattgcttctggattagaatccacaccataaatgtttgattcaattaattgacaaagtttatcattgtcttttatatatccattagcatcaacatttttactaataataagttgtaaactttcaactaaaaatataccagaaccacatgatggatcaagcactttacattgagaatttttagttaaaaatgtacctaaagattctttcacaatataatctgccaaatattcaggtgtataaaaagctttatcatcatcttgcgctttttctcccaataatacttcataaatattacttatcaattcaattggaataatattaaaatcatataaaggtaaaaatgataactgtcctgattccatttcttgctttcctgaaagaaaacactttaatagttcaaatacttcatcattaagtgcctcatcataaacttcatcttccaactcaaataagttaccattaaatttattctttaaatatgaaaaaaaactatatagctttcttttattattggctagtttcaacaaagcttcttgtgattctttgatatcaccattaaaaccatcataccctatatcaattcctctatctataagaaatcttataaatattaatctcaatattaattttgttgcaaattttactctatactgctttttcagtttttctgttatacactttatatttttaatcattacttgatttaaagtgtctttagaaaatgctatttgatattctcttaaaaattgctcatttgttatattccaatatgaaaatggtgacgcttcactacatttcttatgctcttcctccaatacaaactgtaacctaatattatcaagttcagataaatccatagaattaccattaaatacttttatactatcataatcattaaatattataataggaatttgagcattccatatttttttatataatttttgtttactatcattttcagatatataatcaaaaaaaagaactttaggctttccattgactacaaagaaagcacatggttttatttcatttaaaactttcttatcatgaaaagaaagatctttacacatattaatattagcaaaataatataaattcttcgaattatggtatcctaatttcttaataatcatctgagtagtattcgatattctattcaccatctcatctccttttgctaatttttattacttactaaaacttccacgcttaaagacatagaagttttagatactatataacttctatattatttctaaagtataatattactaatcatttttcctacaactttcaccatcaaataatcttatgattatattgataataatatacaccttcactactttagtatatcccaaattcaggtgaaggtaaatctcaactttaattttttatactaaaaggtagcaaggcttgtataatcttgctacctttctattatgcttctggaactgttgttgtttctctcaacgctttaagctcttcctgaaactgcaatatttcttttattatattttgtttatttctagtagtgaagcttagttgatttgctttagatataagctcggtcatttctttttcactggctaatatattgtttttttcagcattctctttatatttagctaatgtttccattacttctatataccctttagccttatccattctacttttatattggctgctattatctaatctatttgttgctttttctgcttctttatataggtccttaaattcatttaaattatttattatatcagaataatttagatatgcatctagcttttctactgcatcccttgcttgtatcgctaaatccatttgtgacactttattagttgtatctagtcgcctttgcaattctatttttatatctgaactttctaatttatctatagctacttgcgcttcttctattgttttaggatcttttgttgttatagcttttcttattaagctttctatatttcttattttattacgttcttcttgcttactttgattttctttacgatctatatatggctttaaagcatctaatactctttgcaattgagctttttcatttttatatatagttgtatttagatcatgaactgctttttttgcatattcataatcttctttatctaaagttgtctttgcttttttaacagcattataagctttaatataagcatccttttctgctttgatttgtttttctaaatcatctaatctatcagttagatcatcttttactttaccatctggcaatttagctactttttctttagctctatctatatcatcttcatttttactagtttcagccttttccactgcttttgttgcatcttctaaatcttttttacctttgtcttctacattaacatttacttcagaagatgtactattttggtcattcatgttacctgcattatctatggccttaacctttattttatgagcacctggagataaggtcacttctctagtatattttacaaattcaccattatctattttgtagaaaatttcttttataccacttaatttatcactagcaactatagtcattttatagtctttaatatttatattagcaattggcaattccttatcaattttgtttattgatacttctttagtagtcttattgccagcctcatcttctactataaacttataagttccgtttttacttatagtaaaggttgttttatctccatttacaacttcaccgtcaggtagtgtaattgatttaacttttttattatctttagccgttacatttaatataatatctttattagtccaatctacaggattgcctgttacttctaatgttggagcttctttatcgatgtcttcattgtctataataaattcatcactttgatcatttaaattccctgcattatccatagctctagcctctattgtgtgatgacctggagataaggtcacttctccagcatattttacaaattcaccatcatctattttgtagaaaatctcctttataccactcaaattatcattagcatctataatcattttattaccttttacatttatatttattacaggcaattctttatctattttatttactactacttctttagtactcttattacctgcttcatcctctacgataaatttataaataccattttcatttacaataaagtctgctttatcactatttactacttttccattaggcatagttattgatttaacacttatattatctttagccgttatgtttaatacaacattattattggtccattctgttggattacctgatacagctattgtaggtaattctttatctatgttacttatatctatttgtttactagtcttattacctgcattatcagtaacttctactatataagttccattagtagatacagtatatttattgccttttattacagtatcattaacttttatttctttaacaccacttaaagtatctttagcatctatattaatgtctacattaccattagtagagtttgttgtagaagttgctaaatttaatgttggtaattctttatctatattagataccgtatagtcaacggttcttttattgcctgaagtatcttctataataaagtcatattttccattcttgtcagccgcaaaagttgctttacttccagcagttactttaccatcgggtaaagtaatagatttaacacctatattatctgttgcagtacaagttaaagttacattaccattggtccaggattttttatctgcagtaactgttccatttggtaattccctatctatattgcttatagttatttgtttactaattttatttcctgcattatcaatagcctctactgtataaattccattactagatacagtatatttattacctgtgattacagtaccattggcttttatttctttaacaccgcttaaagaatctttcgcatctatattaatgtctacattaccattagtagagcctgctatagaagttgataaatttaatgttggcaattctttatctattttatctactactatttctttagtaattttattacctgcttcatcctctgcagtaaatttataagtgccatttttagttactgtatagtctgctttatcactacttactattttaccatctggcaaagttattgacttaactttgttattatccttagcagatacatttaatataatatctttattggtccaacttgttgtgtttcctgttacttctattgttggtgattctttatcatcaagttttatatgttcatgtttatctatatatttcactagtgtactagatttcaaatttaaagtaggacgaacgccatcaccaatcctattgaaattaatgtcacggtagttgctggtaccgttactgtagacataaaacacatcgacgtcggtgcctgctggaagtgcttgaagggttagagtagttggaactctagtccaatatgtccattcataatccctatccccaaattttgctatccttgaagcattatcatgaaaagcattaaaactactaccaacaggttttgaattacaaacttttagtcctatttcctcaagagatggaataaatattttatcatcagtataatagtcttctttaccattaaaatttgtatttattaaatgtgtttctaatatatttgctttcagatctttacttaacttattataaaactctccatttaagtatgccctcaatgatgaattaccccaatggctactaggaagagatttagtatcaaaaggtcttttttctaatatatctttgctcattacagttacagaaccatctggatagccctcatgattcttagctactactacccaatcaatacctgatatattaaatatatcacctaccattaacttatttacttctattgtatctcccactttaatattatcagctgcaaaagccttattatcttttacaatacttaggctattatcttgcatacctatacttataggcatagttaatattgttcccaatgtggttactcctataagcgcttgtgttatcttcttgtttattacttttttatcatatggcttcatattatatcatacctccgaaatgtttaattaattttttattattacaattaattattatttaatatttaaaaaaccgtacttctttctaattaatttctaaaaaaatattgatatttagtttatatacgaagcctacaaaataaaaacattttatatccatatatttatatatacctatctttttgttagggtttaaaatttgtaccctattgaaaacataaaaaaacactagatacttttatacctagtgtttcatacattattttatcgatttcgatataaaataaaaaacttctaactttaatttgttagaagctttagatattaatttaagaaatattgttttgtgtcttacaattaacaatatttaatattttttcaacgttttgattttttataaattctgtattgtttaatggcaatacaaattgcaacaaatcagtattttcatcttttgtcaaatactcaaatttattatcattataaaagttaatcaatttttttttgttttcgcattcaactaatacgagtcttcctccaatgaattctctacatttttttataatatttatagcataatctaatatttcttttccaactatatcatttttatatttatcatttttacctaattgtcctatcaaataacaattaacttctgaagctttcttatccataccatcatatttttgtattttacttttagaaatattctttggaagtgtaattttcttctctgctaatgtaaaatatcctagaatattaaacgctccattactattaagtggattttcttctggtacaattaaataagttctgcttttgtcagcttgttcaaatctaattgatttttcttttagaaatcttgacacatccctattatttttacaattaaaatctgataaaagattatttatctgcattttagaatcaaatgtttctaaaatagaatttagcgagagaataaatgttttaataattccttacctctagctagcttatcttctacatttatgtcttcaatttctattttatcatttcgttcctctgatagtatatgtaacaatttatcactagcttgcttgtttaaaacaatatctctatcaaatgatattgtagccatatccacatcccccttttctatctcttgacaacttttctttcttttcaatttataaacttttttgcaacctatcaatctctttatacccattttatcacctcttataccaaatttcaacaattcatcaaagaatttaattaaatctatacatatataatttatttcgttaatacttaataagtagatagtatatttattatattaccataatttggtataatattgataataattcgtataaaaaatatagacaaaatcattagaaaaaggtgcaaattatatattaagatacaagatttattttacaattttattaaataaatataaattagaatcctatattataatgagtttcagcacccttgaatcctagatcattagttaatttttcattatggtgtaaattggtagcgttgaatccgttaacaggtaccttaatctcagctttacatggtatttgtactagctttcttattgtttgctttgtacctttctcttcatctagagtataagttctagagacataggcctcagcaataaaactaatagttaggagcggattatctccagcataatcaaatttaaatatgcatgttccaccattttggtctagtttgcaataatatggagaagtataatgtcttccattaccaccaaatctgtctaatctatgatttactgaccatttttttatagtagctcttactccatctatatataccggacttaaagatatattcatggtatactctgtttctttacctttttcgtccaggtgatatctggtgaatgggaatttagcatcagtatttattatcatatgtgcggaaccaccgctgctgccaccactaccattgcttcccatattaggagtaaaacctgttgttttatattcccatctataacgctttacttgtcttgtcttttgtactggtcttgtttttgttatattctttttagattctacttgtatccctaatctcatgtaaatcaattgatctctttgaccaccaccatcaccaataacactaacatctgttacatcatattttgtgaaattataattgctaaatatatttttaatttgtggcaatgcttcttctgcataacttttattcccgcttatatgaatcggataacgagtttcagtccaaatccaactaaatccactgactgatacagtatattcttctgtagtccaatatttctcaatagtccaataacctactctttccatatgacttgtatctatataaggcggttgtttattactatttttataatcataaacacttgcagcagatacaagacttgattgaattattaatataataaaggatagtataatgattaataatctatttcctttcatactttcacttccttacatgcttttatatgattattattccaaaaaaataaaaacaactattttgacttttaatagttgtttttatttgaatatttttatttgattatacaataagtttctattaaataaggggaatttttttccggattatcaggatacctaactgcaattagtaaatcttttggtaaacttgtaggatcaaaactaatacattgctcacctccatcttcccctttcaatgaacttgcatcaaaaactgaacaatcattataatttaaatactgtccattatctaactttattccattattatcagaataaacaacttttgcaattagtgtattctttttaaataaaacatcttgtacatgaaatggttttttataatcaattaacatatatgaataaggatttgttctcattaaaatagcatttttaattaaatcttcttcccatatattaattgactgatatttagtattatcttgtatccctactctattaagcttaggctccaagaaattaagtttcttgcctcctagcattggatgcttatctccaaatggatttgcactaaaatctcctttgtaaacaattacctcatgcccattaatcaattgaacttcttttgtaaatttattagctggatttttttgagcttcaggtatataactagagtcaaatccatacttaaaatattttatggtataatcttttttcttattaagtaaacttacaaggtcgtccattttattcatagttttaataaagtatatttgtgaagaataaggtaacattgttttaatcttattcttattaacacgaacaccatctataataacaattaataataccactgaaattaatctagttaatttctttctattcaccaatgtacctcctttctacagtcaatcttagatatattttaaaataatactgctattttttgaataccttttatttcattattttctttagatattttaactaaagtattttgaggatagtattttggtgtataatatgatgccccatcatatgattggtctaatctttcattaataaatgatagaggaatactatcttttttaacattgaaatattggccattatctagctttataccattttcatctgcagatacaactttagcataagttgtggtgcaaacagtattagaacttttcactttatcttcaacagtaaaaggacctttatattttataaagaaatacatataatcagttccacctagggttgatttttgtttaaaagcatatacatctttaaaaaccttttgatttttagctgttaggaattgtacatttaagtccatatattctttaccactaattttttcttgaccaggagaaaatatcgtttgagctgtaagtatctctgtattggctacatctaatattttttcattattaatatgaatcactgttttctccttagtataatctaccttagcatctcccttatagacagttatatcatccttatataaattttgtgtttgtttactaggtttttgattttctttattctctactaccttttcttgtgtatttttaacaggttttgtatctttggatttattaacacctatagctattccacctactataactacacaagcaataattattgctgttatcttctttttgttcatctaaattacctccaaattatgtttgtatttatatattatttctatttttagcaatgtttatatttatatgataagttaaaagtattatatacacaacaaaaagcctaatttatatattttaaaaataagttaggctttttgttgtgttttaacttttttcgcttattatagtactataacaacgctggtgaatacaaatttcataattaatagaaaggaagtgcgattatatacttaccctataaaataatcgtatctttacatacatactacatataatattagtaaagaatatgcccattttattataaatctagcaaaaactatacctagaaattataaagccatagaaattcctaaacatactgcagaaactaataaccatgctccagctgacataataattcactcccaaatcaaaattttatttatatcattacctaaattgaaaaaattattcaggagggtcttaaaaatgcgagaaatttttaaaattatatttttctttatagcaatttatgcaagcataaaaatgtggtgtaaaataattaaagatattagggggaatgtttgatgattataaatttatctaaaccaagattgtacttacaagataaattagatgaagctatattcaattataaaatgaataatgctatttcaaagcaacaaaagattaaaacatttgtagatacaacagcaactacattaactgttaccttgttattcactacaccagttagtgcagtaggttttgataaaataacaggagccttaaacccacttattgacttgattcaagccttaggatatccattagctgtattatcaatgagtggtggggccataactatgatgttcaataagcgaatgggagtaagaataataaaagatactgcagttgcatatttagttctacaatttgtaccaggactaatgaagatattaatggatataggaaaagcaataagatgattattgaagttattccagacataaatataaataattctaaactatctagctttcttacaaatatacattcatataaaaatctatttaatagaattaatcttaaagaaaagaaaataacacatcaagataaaattatatatgaaattttactaactaaagaaaacatatctttttattatataatcccagatagcttaaaagaattagtacttaacgaattaaatgtatgttacccaaaggctacatttaaatctaagaatacttatagaacatataaagaagaaggcatacttaattttataaaagaggaccatatgatagatgtccatgttgcagatgaacttgaattagatcaacatagttttttaagtttaaaaacagatttgagatcagaatatcctcttaattcattattggaaacttctaaaattctaagagatgatgaaaaagtgttaatgcaatatatattggtacctgaagatccttctttaaatttagactttgaagaagccattaaagaattcaacactgaaaaaaagattaagagtaaatacaaattagataaagaaagaataataaaaggtggacttaaattagcttatgaatgtgttgctgaagtcatggatttagctagtttattttttacagatgaagaatttgaaagaattgacttagatgaattagataataatgtgctcgttcgaaatggattatcccagcaaaccaaagataaaacctcttctgtttattatgatacatctataagaatagctactaatagccaaagaagtgaattactattaaaattatttaaaagaagtttcaatttattagagggtgataataagttagttactagaaaattaaagcaaaatgaacttatagaagcaataaaacaacgaaagcctatagataaaataaatatggatgcattaagcactaaagaattagcgcaacttatgcaattacctactaaacattaccaacagcagtataaaattaagaacatagatactagagaaattaatataccacatgtttttacatcgaaaggattgcaaataggccatactaaatataaaggtaataaaataccactattctttccgttggatgatttagactcattatgtcaatgctggatttctataggtaagatggggagcggtaaaactacttgcggacaaaatacttcaatacagttacttcaaaatggaattagtgtatttgctatagatgtagcagatggtgacttaatagataacatagagaaaggcttaccaaaagattttaataaaattatagatttagatttcggagatatagataatcctatacccttaacatggagtgaatgtgctaatggtgataaaaatgtagaaaccaagttagcttctcaacttaaaaactttcttaataaattggccaaaagtgataatcaaaagttaagtagtagaatggaaaggttcttaggtgctgctgccaaagctgtatttaaaaatccaactgctaatctatatgatgttattctctgtcttactgatagggaatatagggataatttaattgtaactaataatattaatggtagattaaaatggaccttagagcaattaaatgatgatggaaatgaaaccggtacaaaacaaaactatgtatctggaataatggataggttagaatctttactggataatgagtttgcagctaactgtttattacaagaagctaatttagatatagactttaggaaatgggcagatgagggttactttgtaggcataagaattcctaaggatactttattagatgataccacagacttattagttacttatatagtaagtaaattatggcttgctatattaactagaagtaatatacctaaagagcaaagaaagccttgcattctaattttagatgaacctcatcaatttcctacagtacttacagagctgcactcaattataagagaaatgaggaaatggaggtttggcatatttatattagcacatgagtttggagattttaaaaatatgaaaacattacttaagagtgcaggcaccaattattttatatatcaaacttctaaagaaacatataaagaattattggaagaacttcagccatttacactcgaagaaatgattaatactaaatggaggcatgctattgttaatatgagatataaagaagaaaagatttgtgttatgacagatatgttaaagcctttgccacataaaagaacatataaaaatagaaatgtttttggtagatctgcagaaaaagtccaggatgaaatatttaaaaaatctatgcattttgaagatgaatttataaataatatgaatgatgataaagaaaaagaagaaaatgttcaacaaaaagctattatttaagattaattaacctatagaataaggtatagaatagcctatagaatagatgtagaatagatgtagaatttaaaaaatacaaaagagcttataaatggcttgaaataaacattttacacaagattataaattgataaacccttatatatattatatatagttaaaaaagggtaggtgaggtattttgattttgtcggagcgggattggaactttttaaaagatttatatttcgtaaaaatcttgaatactaaaaggatatgtagattatacaattctaaaaaatattgttatgcacgtctaaaacttttaaaagataataattacatcaaaattttatataagcttcctaataaagaaaatgtttttactttagataaagaagggtataaaattttaggttataagccaataaaaattaatgctagtccacaaaaactactaccactagctgatttttatttctatgaaaaaagactggatccatttattaaatttgataataaatattattttagttatgggaacagaaaatatattttaaaaatagatgtgctcttaaaaactaatacatggatatttgcaatattaaataataaacatctagaagagcaaataaaaaaaatagaaatgtattataaaagtaatcaatataaaaatttatttgatagattccctatagttgttataataggtgatactacaaataaaattactgaaaataaaaatattaattgccaatggttagaatatgagaaagttaaagaatgggactataaatattaacagtatatttatagtcatatatttatatatacctatcttctatttaggatttaaaatttgtactctataaagaacataaaaagacctgctaatttataagcaggtctatctataaatggaatgcaaattaaaatcgtatattataataagctctagtcccttcaatttttaactctagttctaggaaaaataatgcaatatatccataataatctgtatatggtataataaaatacaaagataagggggactatatggaaatttcaattaaaaaaaatgataaatttagaattactaaatttatcattgatgaaataaaaattatatcaacgggtaaatttgaagacactagtaaaatatatacaagtgttgttattggagaaaatggagttgggaaaagtattttacttagtaaagtagaaaatatttttaatcatatatataaaataattaatatggagagactgccttatatgagaaatactatatcatatgagttagaatacaaattagatggaaatatttataaggcactttattcaaataatgagatagaattctatatagatgatataaaaattaaagataaatcattatttaaaatacctaataaggtgttatgctgctcattccaaatgaatgacaaattcacatttagaaaagaaaataataaagaaatcattaaatatttaggaattaaaactactcctactatgacaaatacatcatctatatctaaaaaaatatgcaataatattcttgattgcattaataactttgaaaaaactgaatcactaattaaatgttttgatttcttaaatttagaaaaagaaatattaattacgtataaactaaaacaaatacagagattttttgaacatgaaataacaattgatactatagtagataaaatagaaaatggaatgtggaaaaatagaaaaagtgcagcgtttggaaaaggaatattagaagaaataagaaatgataaagaaatgctttcaagactagttaggcaaatatatatatttatgaaggaaagaagaaaaggaaatgagatgcgtttaagatttaagttaggtgaaagatatagttattttaaggaatatattgatttagaagcccttgaaatattgattaaattagatattataagcaatcctaatattaaggtacaaaaacaaggatactatgatttagaaagaggtagctctggagaattacatattttatttttactaactaatattttatcaaatttagaagaaaactcattaatcttaattgatgaaccagaaatatcactacacccgagttggcagataaagattattgggttgattagaaatatcttagaggaagtaaataaatcttgtcatattatgattgctactcattcacactttacagttagtgatttgcaaccaagtaattcatcactacatatacttaaaacagataaatacacaggcaatctaatatgtgaagaggtaactagcaacacttatgggtggtcagccgagaatatacttcttaatgtatttggagttccttctaatagaaattactatctaatacaaaaaatagacaaattgttatctgatgtttccaatggaaatattaaatcagttattaatgaaaagaatgaattacaaagtatagcatctaacttattagattcagatccattaaaagtaataatttataaaatgataaagagagcagaaaaggattataagcaagacaatgagtatacaaatcccatataaaaacagtgcagtagatagcgatttaaaaaatggaactgattggacttctaaagatgctaagtatttaaaaataagaaagaaattaaaagattatttatgtgatataaactctcaatgttgttttttttgtaaatcaaaaatcaataccggtaatagtaatggaactattgaacatatattaagcaagagtgaatatagtatgtttacatataagcctgaaaatttaacatattcttgcatacggtgcaatttattaaaaagtgcttctaaagtactaacagatgaagaaataaagaaaaaaatgaactatacatataatacttatccatttgaatctaagtcttttaaaatcatacatccatatttagatgattatgataaatgtattactttagatgatatattctacaaaggaatagatagtgagggtaaaggtagtaacactataaaactttataatttaaatagacttgaattagcagaaaataagataaaaacagagcctagcgcttttattaatcaatttttgcatttaatatctaatggatataatctaagtgaggaagaaatagaatcacatatagactttatatttgataatataaaagataatgcgataaatatttctcataggcctattacatttatagaaaagtttcttaatacaaataaaaaaaataatgcaaaactaattagtgctatcaatatactagatttaaataaggtggatatatttaagcattatagaattatgatcgatgaactggaatcctctaagcaatatgattatataaaaataataaatagtacattttacaatttggaagaggaaacaaaattaatcaatataacagaagaagttttaaagacaatttcagctttaacgcggagctcagaaagatgtgaggaattagaacttataaatattagtcatatgtttatgatgataactaaatttgataagtattctaataatgaagaacttaaaattaaagtttcaatactaaataaacttgcttatctatgtatgtgtattggtttttataataaaaatgaaaatcaaaatgtaattaaatcagaaccaaatacaaaaagattaaaagagaaaataaaaaaagataaggagtatttaaaaatattaaagcaagaattgaaaaatgctagaagagtagcgcaatgatatataagaagaagtgagttaaattaattcacttcttttaactttccaactagatattgtttcaatttggcgtatatatttattatcattttttaatacttcattactcattatagttacaaaacttttgggatgaccttcatggtttttgtctactatctccaatgaatcatcttacctaaaaataaagagactacatactatccaaataaatgaatcttataattgttttatatgccaaatagaactttgtataatagtatcattaaggtcctagtgtatttataatattttttcgccctattttaaaaccacttttaaattaattaaaattggataatttccatattataaataactttaaatagctatctcactttaatcagaaaaatatcttgataaaaagttagacttcctttttttttaaacttagataataattgatcatacttttcataaaagctattcccaattttataaataaaagattttccttttacctctgctattttttctaaagattcttctactatattatctaaatcatcatctttagaagataatgtaaactgttgctcgtttataactaacttatatttatattctttatagcttgtactaatatttttaaagtatttcttaaatatcttccaagagttttttaaggcaatagaaatactacatttagattttctcacaattttccatgctttattcattacgtctccagcacagcttaattgccaatagcctaaatctatttttaacataaaactatcgccccttataatttattaatagcaggaattaatttccagctatttacatatattatatatgaagcttaattttatttcaagatattaaaaatattttatatataaattaacatcagttcccaatttagcgaactgatgttaatttatgaatattatcttttaagtaaattataaatatcctttttatttaaatcaaatattctttttacaagagtatgtgcgaaaagcccactcctttaggtgtaggatggatagcacaagataatatataaaataatttaaataaatgtgtataaatatattgactacatacacaaatagtaatataatgaaaatatgcaaaataattatagaaagacaaaaacaacagtaagtttaattaattatcattttgtattttgtcctagatatagaaggaaaatatttaatattcctagtgtagaagaaagatttaagcatatagtcaaatatgcatgtaaggagttggatattgatataatagccatagaatgtgataaagaccatacacacatgtttttaaattgtcttccaacattaagtccttcagacataatgcaaaagataaaatgcgtaacaagcagagctttaagagatgaatttccagaattatcgaagatgcctagtctatggactagaagttattttgtttcaactgctgggaatgtatgtagtgaaactattaaaaaatatgttgaaaatcaaaaaactagatactagaaagtgaggtgaatattcatggctaaagctcctaaacaaagatatgttttaaatttaaaattaaaaactcaaccatttcaagaagatattttagataaacgttttgaaataggaagaaaaatatataatgctgtgttaggtcaagccttaaagagatatagggaaatgattaaaaccaagagatggagagagaatcaaaataatatatcaaatatatataaagtcgaaaaagatgataagaaaagaaataaactttgtaagctatattttaatattaaaaacaatatgttaaaagaatttagattaaatgagtattcacttcatgcagatgttaaacaaatacaaagacattttaaaaagaatatagatagttttactgctcaaaaaattgctactagggtttataaagctatagatgatagtttatttggtaaaggtgaagaaattcatttcaaaggtgtaaacaaaccattgaattctttagaaggtaaatctaatggtactggaattagatataatatagaaactaatatattctcatggaatgggctagaaataccagttaaattagatattaataataaatatgaaacagatgctttaagagataaaatttgcttttgtagaattaaaagaagatttgtgcgtggaaaatataaatacatacttcaattaatacttgaaggtgtcccacctattaaaattaataaacaaggtgaagttaaatatgatataggtttaggtgtttgtggtattgacataggaacaaaaacagttgcttatacatctgattatgattgtaaactattagaattagcacctagagttcaaaacatagaaaatgaaaaacgcaaaatattaagatatatggataggagtaaaagagcaactaattctaataagtttaatgaagatggcactgtaaagcgcggtattaaactagagtggaattattcaaataaatatataaaagcaaagaataaacttaaagatttatatagaaaacaagctgatataagagaacaagaccacaatataatgattaataaaatactaaaaaattgtgatacggtttatgttgaagatatgaattataaagcacttcagaaacgtagtaaaagcacagaaaagaatgataaaggtaagtgtaaaaggaaaaaaagatttggtaaatcactagcaaataaagcaccaagcatgtttttagctatattgcagaacaaattaaaagctaaaggtggatggtattataagataaatactagagaagtgaaagcatctcaatataatcatttaaataaagaatataataaaaagaaacttagccaaagatggaattatcttaattataatggagaacaaattaaagttcagagagatatttatagtgcatatttaataaaaaatgtaaataatgatttaaaaagcattaataatagtcaatgtgaaaaagattttgataaatttttaaaacttcataataaagaaatattgagattacaaggattaaaaaataatctaagtagtattggtatataagttattaaaacgtcttgaaatgggcgttatactatcgttaatcgattggtagcaatctttgatagtaaaagtcttagggaaaataattagtgatattatactttcaagataatatagaagttatatagtacctaagaaccccatgcctttaggcttgggagtttcagcatctagttagttattattactttttaaaaaaatagaagaactatcttaatataaaactaagatagttccttatgtttaaataaaattataatagatgtaggaagtaagggagttgtcatttctacaactattgaagatatacttataaaaaaattacatgaaataattaataaagaagactcacatccatatttttaatatcttccgaaacttataaaaatatgtgattaggtttttattttactagaataaaaaaatctaataatttaatatggtaatataaatgttataatttaactaagttttttaatactttaaatcgtaatatatatccttttcgtctgtatatggtatgttccaatatgcacgacattctggtagatgtactctccaaccacgcccaattttttctgtatttaataatcgttcttgttgacaagcttgttttatagtaatttcaggaatgtctaacaattctgatgcatactttattgttaccatagatgtaatcataaaaaatgttcttctaaatacatattggtctaattcatattctaaatgagaatatgtttccatcccaaaatgtagttcttttatttcgctattgtctattttatcctttaattctacgatatcatttataatatcttcattattgcgaattctcattttagcgtgtttaagcaaattgtttactgccttagaatacgtaagtgttggtcttccacctgttaatacattttctaaatccctatgtgttatatattttatattagtatttctttctgcatagcgtataactataaattgcaatctaactaaatccgctatgatcctttcgtatttactagcttcgcttgataattttgctctagccatttatattcctcctaatttttaataaaatacattttttatttgaggatttttaacccctcaattttaagcttctcttattttttcttttataaatttacttctttcttctatcttttttaataaatcattataccaccattcttctgcttcctcttgtgtaggaagtttacaagtacattctggtatatcatcttgatcaaagttttcgtcaaaactaaaattatagtaacaatgacaaaaactttctatatattcttttatttttctttttttatctttaacctgactataatttactactacataaaagttgcaatcattgtttattatactttcttctgtcatgctttcgcttaaaaagaataattttaacccaccaaaatctccccagcaaccatatataggcctgcacattaaatttagttcttctccatgctccaacgccatttctataaattttattttttctataatttcatttttatccatatttatacctcctacataaattcttttataagatatctatctgttgtcgcatctgccatagcaaaagattttttaacttcaattaatctttttgcagatgtttcattctcaatattagtttttacttcatctattattgaatttaatatttttatagcttcatctatggttgtttttttgcttgttgctcttttaaaaatttcttttttgtatctatttaaataatttatttgaaagtttcctgcattattaaatctttctttatattcttcaacttcctttattaattcttttttaatgtcttttgcccattttatttgtttttcactaccaattagttctaccactttattatcccctttcattttttgaaggtaagatagacatattgcaaattgtgctttatagtctacttcagggaactctttttttatttcttttgtaggtttgtatgcttctttaaatgagtttttcattaatcttacccccttttatttattaatcgctatcgattacttttaattatattatataatcgttagcgattagtgccaatatttttttattttttctcaaaaataaaaaagaaagtaaattattacattaaatataatttacttcccattgaaattgatattaaaaatttaactttaactgaccttcttcagaaataataaattcaactttattattaatattttttgcttttgctgaaactttctcaattttgtctcttatatcaaataagctactataatattctttaattaataatattaattgctcatccaaaggataaataatatttgttttatctaaacttttaattaatgaattatctacttttaatatattattcaaatatatttccccacatctagcaaagacttctgcactattagtataataatccttgttatactttgtctttccataataaatctttttaaaagaatcatcagatggtagatcatatatagttttatccaatatctctatatatttattttttatttttctaaaattatatttactacttaatttcaaactatcaaatttatagccttggttatcaaccatatgcataaattcatgtagaaaagcactaggatcacgcaaatctacacataaacatttttgtaatgggaaatataatcctactgctttgtgtttacctaaatatcgaaatcttaatgatacctctttcataaatttcaaaatactttcattaggatttaagaattccaatgtatcttgaaattcattttctacttgctttattttcattaaatcaacatcattgtcgaattcaacatttttaaaataaatattaaatgttgatttctccatagcctttaatgttttattacttatattttttttcttttgaaaagctctagcataatctgaattcatatttgctatttgcttttcttgaattattatgtctttattatcaataactatttccttgaaaattgctcctaaaacttccttagcaaaagtagacatataagccgaacctacttttgtaatgctataactagtttttaatgagcataaattagaaatagtatttttctctccagttataaaatattcatttaagtaagttataaagggcctataatatttcactttattatttaaggaattaataacatcaattactatttccctattacttttattataatttattacttcattaataatatagacctcactaatagctgtgaaaaaatctagtattttaatttttttattattacacctaaataaatatttacttgttttatcacctattcttcctcttaatactgaataaaaagaaaaactagtgttaaatttatcagagatagtacacttaataggaactaatttagatacatactctattatattatttggagtttttgtccctgatgtatatcttaattgtgctctgcctatagtatctagtatatttttatctgttatttcttctatatcaatttttaaaaattgaaattctttatctatttcgtctatcaatttttgatcatttgtttccactgtttttgcaaagaaatattttttacttatttcttttactgcttttataaaaaactttgtattgtctaaactgatatctaacttaacttttttatcgtagcttaaacaattacttatattcctttcttttctttcctttaataaagaagttatcttattatttgtcattttcttttcccccttaaattttagctgtaatttagccataaactattgtttaactaattattattactttactaaattctttaagggaaatatgaagtcatatagaataaattatctattacttgatactagtaaatagtatataatatacatatagacattaatccttctatttcattttaaatacacaaatgataaaagtagcaagactatttaatttaagtcttgctactttttttaactgtttaaagttagcatatttttttaacatgcatatatccagttattatcttttttctttaaatatataccgcaactaattttagggttaataagtaaaatagttttattttctcgatttttttctaaatgccatagtttattacaatgcggacagctaaagagttcttttgatctaccaaataaattaggtgttatttcatatctatgaccacatgtgcatgttaatataggtttatcatcttccatttctaatccaaattcaattctataagtaaatttactcattaaattttatctcctctatttttttaataatttcttagttttttgaattaattactttagaaaactaatgggatgcttatccttccattgtattttttatttcttcttttgtatagttaaaatatttcacccttcttaaaggttaattttagttttattaaccatatcataatatttaattaattattatctcgaaaaagaaagattgcatttctaaaaaatattaatattttatatttttaatatgtaggttttgaataaagtttgatcaaacctacaataggtttatcagcataaataaaaagagcatgtgttttgaattaacacctgctcttttttatattcattctgtccaataaatgtttgtttctctattagaatataattcaattatttatcattacaaaagaaacaaattttacttctattttttaatatttttatttgtatccttattttttataatatcgcctatagctgcaatatttcctaatgaagataatgtttcatttggaagtattaatttattggctggacccttggccatttcttttaatgcttctacttgttttaatgcaataacagtttcgttagttcctgattctattatagaagcattaacatttcttatagcatctgcttctgctttagctatttgtgctattgcttttgccttaccttcagcttctaataattgagattctcttaatccttctgctctccttatattagcttctttctctgcttctgcatttagaatagcagattcttttaacccttctgctttatatatagcagcttgtttttcaccttctgattgtagtatcatagctcttttatctctttcagcttttaattgtttttccatagatgctaagatatcacgtggtggtactattcccttaacttctacactaaacacttttataccatatgcatctgttacctcatctataatagctaataattttttatttatttcttctctaccagttgataatatctcatccaaagtcatatttccaacaatatttctcatgtttgttatagatgaatatactatcccggcttgataattttctatattatatactgctgctttgggatctaatatcttataaaaaattacattatctatagatatattaacattgtcttttgttataacactttgaggctctatatccaatatttgctgcttagtggatattctttgcctaacaaaatcaacatatggtattataatatgccaccctggttctaatgttctatgatactttcctagtctttccacaacatatacgtaacctgtattcactatctttattgatgctattattgttgttattaataaaaataaaataaaaattataaataaaatcttcatataaaaaacctcctgtttattttatagtaattatatatacaatttttcttttttaaatttttatttgtaaaataaaaaagaattgggattttttcaattccaattcttaaaggttttttataatttaaaattagttgtattgcgaattaatgcaatactattaattgtattataatattctttttcactataaaaagtctgcatagctgatatttccgatatatcagcccttattgaatacccacatatagggcatgctttaaaaaatgttattttgttactacttttatcttctttacttctaacagctagcttttctccgcaatgtttacaaaaatctctatttttcatttctttttcccccttaaatcttagcaaatggccatacatatatatgtatatatttattattcttaattttgaaatctaatgcataagagcattaaatttttgttttttatattcttttactattttgggctccttttctatgtatttatatacagaaaaacttggattaatagtatttctgtaattttctctttccaaagttatatttattttctcctccagaaaaggtatattacattctttgtaatacgccatgaataatttttctctatttaaaaaagagaacttaggttttatttctaaaacacatcctaggtattttgtttgctgattttttataaatgaatatttttctgttacatttccattttctacacaatataaattaagaactacattatataaacatcctttatgttctaatttttgctttaaacgaaaatattgttttatgtcttcttttgttaaataaaacaatacataagcatttcctatgtattttccttttctatttttatgtgaagaacaactagccaccgttggaaaatagttattaatataattaaccaatggttctatagctggatccagtttcaaatagtcttctgtatatagactattttttttattaaccatgtttactaactccatatttatcattttaaattccccctaatttttagctatatttagccataatttatactctaattagttattattacttttttatatgttatattgtataaatagcaaaattaacctattatatagataaaatcccctttaatttttataaaatataaaaaaagaaaaggtagaaagactttgaacacatagtcttcctacctttttcttttaactatattaataatattatttaataaaagcttaatttttttattatctattaaatataatgttttaaaatctgaaaaaatgtatatttttataacatgtcctttatcatttaaaattttaaaaccataaattacttatttttttattgtacaatctaataaaaaaatttattataccagcataaatatatgaaaggagtaagttgagaactattgtatttttctcaacagtgatagacatgttatcttattacgaattattattagaaattaaattaaataaggatatacattttagtaagtcttatgaaatgttatctaaattttttaatagagtaatgttgacagataattatcttaaaacattacatgaaaggaaaggtgtaaaattatattctttttctggactgtatccagcagccacaaatcaaatttataaaagaaatgccctatataaaattagaattagaagttttgatccagaatttatttgtgctatgcaattctcattaagccaaatacaagacaatgatataaatataatatctattaaatttataaaaaaccagcaacaatttattactgagttagtatcaataaatcctgttattttttcaatttgggaaaagcagaactactggcaaataggtgacaatattgacttgttaggaaaacaattgactaacaatttattacataaatataatactatatcttgtaataaacttacaacacaagatacaatatttcactgtttaaacataactaataataagactatttatattccctataaaaaaggattattgttaggtaataaattaaaaatccaagtcaaagaagatgatatatctcaaacacttgctactgtagcactcggagcaggtattggtgaaaaaaatagcattggtatgggattttgttatggacattaaccactaagaagaggggtgaaatttaattgattattgatatgatgcacaattttaaacatttatatgatgaaaatggtgacaatttaatagtagataattatcctttaaaacaaggtgtttacattatcgttaatgatagaggtattagagattttatggttataaaagataaagaagcaataccaaaagataaagaagaattatttaagtatctaagacacagagattatctaagcatattgaaacaatatgatactaacaaagcagtatctggtagagcgaagtctattcatagtaataattttttatcattatttattagagaaaataaatcttcacatatattagaagattcatcattaaatccttcattagagcaacaagttagatggtattttgatcaatttaaaaagtggcaagaagaagagaggcaggcccataataacaatgatccaagtaatccacaagaatttatattaacaaccttagaagattttgatgaacaattattcaataaaagtaaaaaggctatattaaattctttatcaaatttgccagaacttttaaatgaatatactttggcagataaagattatattagaattttttatgaaatgccaattgaatattataacaaagaatataagaggtacatgataagaaaaatatttaataaaaatgtatatcatatatttaaagataataatgtgtatggtatttctgatatagatcttaccactaataataacaaaccatctttattgttatacagtatgaatactagggtacctctgcgtttagactttgataccttgctaatagctcaaaaactatttgactttctctatttttataaggttcctagatataataaagaatctaaagcagtggaatatgttaatagtatttataaaaccttgtatattccaatggatttcaatatagataatctagatctaaacaaatatactaatacagaccagcctgtttattacattactactggtaatggacaaagttttaatgtaataaactatgatattatttacccatttgattcaaatattgattttagctttaatgattatttatcttcagatgaagatgtttatgaaaataatgaagatagtatagatgatacatcaaatattagcaatataaagactcttttagatttagaaagaattgttgataagtatttttttaactttaacttagtaagtaactatcatagtgataaatttattaataataaaaaatatactttacccaataacataagctgcatgctgttttcttcaaaacatttatttcatgattggtttaggaagggtatagatatagatattattgatcctataactaatgtaatggataatttaatatcattatgggcaaatgatcctgatattagtcttattaaaataaaaaatatgctgaatttaagatggtccatacttgattatttatatgagagagaggggtatgctccaatggaggtaaaagagcactttgaagctatacgttataatttaaaagaaaaaatacatgataagtctcttgaagaaaaatacattaataatactgaagaattttattatgcttgtggtcaattaatctattatttattaacccaaaataaaaaaacattaaaaaaacaacaatctacaagtaaatttctacaatgcagaaatagctcaacattaaagatagaaatattaaagctttatgaagaagtagcaaataatatatcagcttataattacagatttaataatctatattctatggtatctacttataatgatagtaataatacaaaggactatatagattatctactaggtggactttaccaatcaaatattatttatgaaaaaaagaaaaaagaaacagcaaaatataatgattgtacaactattatctaagttgaaaggggatattaaatatgaataaaaaagtatatggtttattaggtgtaacagcagtaaggagtaattataacgcagatttttctagtcacccaagaacaagtgctacaggtgaatttatagccactgataagactttcaaatatgcatgcagaaaatattggacattagataaagaaaaagtattggctttctcaaatttgaatgataatttgaatccaatgacattacaagaaaaatatgagtatttattcaatactaccatagataaaaaaacaacaaaacctatagatgttttatctaatttattttcttgtttagatgtcttaaattttggtgctacatttactatatctaaattaaactttagtattaatggagctgttcaaatacagcaaggtaaaaatgtatatgaatatgctaaggcagaaaaattatctcttctaacaccttatagaaatcctaaagataaggatgatggctcagaaaagggaagaactactactgctgaacaacatattttagatagagcagaattcatctatccgttttctatcaatccagaaaattatgatgaatatgtaggattagtgcctaattttaatggatatacagaagatgcatacactaaatttaaagaagcagctagggtaggggtaacatctttaaatacttgctcaaaagctggctgtgaaaacaattttgcattatttatagaattaaaggattcatcaaaagcatatttacctaatttatcttcttacttaaaatatgattttgattcaattaacacatttgatctcactaatattactgaactattagaaggaattaaagaagaagtggaaaaagtagaagtatattacaataaatacttatcagatatagttatcccaagtactgatataaaagtagaaagaagaaatattctaactggcaaagaaataatatagtttttaataatttaaatcagagaggagagaaggcaattccagcctactttattgaattataagagtaggcgtatacttgccgattttaaatggaagcaattaaattcaatttatcaggtcctacagctttttttaagaaacctgatgttaatagttatgcctactttacttataataatattcataagattgccttattaggtatattaggttcaatcataggactcaaaggctataatcagcaaaaatctattgatacatatcctgaattttatgataagttaaaaactttaaaaattagcatagtgccaaagagtaaaacaggatatttcactaaaaaatttcaaacttttactaacaatacaggattttataatatagatattaataaaagaccatgtacattagtttatagagaacaatggttagaaaacgtaagctgggatatatatatattattagatgaaaatagtgttgataaaaaaattctaaataaattaaaagattatttgttaaataagaaatgtcactttattccttaccttggcaaaaatgatcatactgctgatatcacaaatgttgaacttattaacttaaaagcaatacaagcacatgaaaaattaataagaatacaaagtttatttttaacagataattttaatattacaggagaaaaacataatcctaatgagagattaataatattaaaagaaatgttgccaactgaattagatgaattcgataactcttacaggtttagcaatttatcttttactaatctcattgttcaaccaaatactagtaaaacattaatttatcaggattcactaagtaatttatatttcttttaaaaatttaacttaacgggcgtaattctcccatcctcttaggtgggagatggatagtactgaaattagctatataattttggtaataagcgaggttggttcgaccttttgagcgtgagtaaacttgctacagtagtagtatttcatccacctcttaggtggtggtagttcacaagtcatataatgaaagcatgttataataattatataaacattttattatttacaaacagcttatttttattgatttaacttttacattatatgtatttaaaccttaatgaggaggttgtttaatgaagaaaaaaataagtttaacttctacattagatgtatttaagccctccatttctaaactataattaattatgcttaacttttgcatacgatgcatttaaacctttatgtgagttcttttttatttattgttattgagcaagaactccaattttactgttttataaattagtttaacttctacattagatatatttaaaattccgtttttttaaaataggaaatttttaataaaaaaatacatttaacttctacattaaatgtatttaaacacgcatatttgaaatatcgatttataaaaatttttagttttatttaattttaactcctgcattagatgtatttaaacttataaaaacaaaaagattttcatttatcttaatgtttaacttttacattagatgtatttaaagtacaactatgcactattatttgtttaacttctacattggatgtatttaaacaagaatttaagagaggttttacctaaaaataagatacgtttaacttctacattagatgtatttaaacaaaatcggaggctttttaataatatttttaataagtttaactgctacattagatgtatttaaacgaaacattaaatttataatctgaaaaggggaagtttaacttttacattacatgtatttaaacgtgttaatagtaacaataaaaacaaataaagtttaacttctacattatatgtatttaaactaccgaaaaacacaaaaaagatataagaatttttcctatatgtttaacttctgcattagatgtatttaaacaattaatttgttctctcatttgtaaatatacatatgtttaacttctgcattagatgtatttaaaaagtataagtttaaatataaatagagaaagagaaggtgcaaaaatgaagaaaaaaagcatagatagagcttgctatgttaacattttacctaatttatatataaatgagccctcagatgggttaatattaacagataaaatttcaaaaatccattatgaactagcaactgataccccttgtgatagaagtgatttaacatgcttaaatactgattatcaaaacagtaacttaaatatacttatggagattaagggaaatttatcttttactcatatagttagagattcacatggatttatttttgcagtagaaatagcagatttataaaaaaataaaacatttaacttttacattagatgtatttaaacaacacatatttggaatatcgctaatggaataaggtggtttaacttgtacattatatgtatttaaaataatttattattacctttttagtttaacttctacattggatgtatttaatgacctattttatttaattaatgaaagggaaaatagcttaacttatatattatatgtatttaaactaaactccgcaaacgtttattgtcctaatttttattagtttaacttctatattagatatatttatactagcaaggaacctcctaatttcttattgttaataaggcttaacttttacattaaatgtatttaaatagcgtgtgtaaaaaacaaaaagaataactagtttaacctctacattggatgtatttaaactattttattgattattattgcttcttaaaaaaataggtttaacttctacattaaatgtatttaaacatacttaggaatattaaaaatctttcagtttttatgttcaacttttacattaggtgtatttaaacggaggttttttaacaatatttttctccttatttaacttctgcattagatgtatttaaacaaaaaatagggattttgtaagcattaattttttatgtttaacttttacattagatgtatttaaagtacaactatgtactattatttgtttaacttctacattagatgtatttaaacgaaaattaaatttataatctgaaaaggggaagtttaacttttacattaatttttgcagtagaaatagtagatttataaaaaaagaatgcatttaacttttacattgaatgtatttaaagggacagagagatatataaaatttagttatataagtttaacttctatattagatgtatttaaacggaataataataaaaaagaaaaaaatattaaatcagtttaacttctacattagatgtatttaaactactattttcctccatgttttttaatttttctaagtttaacctttacattaaatgtatttaaatagtgtgtgtaaaaaacagaaaaaataactagtttaacttctgcattggatgtatttaaaaactttcagaaggcatattttcttaaatatttggtttaacttctacattatatgtatttaaactaccgtttttagaaaaaagattgtttcatttacacatataatatataaaaaagcaaatagcttaataattcaaatagccatttgctttttctatattactttaaataaatcttctaaattaagtcctatttttgtagctagtttcatagctatcctttctaacataagactttcttctagtgataaattttttcttatttttctttacactgattaataattaattctatttcttcataatcaatttctccatctccatcaactatacattcagctctaatccattctgctatattctttagcatcctttttgctgcattattttctcttatacttaattttctctatctgttaatgcatttaaacactcctctagatcctctacagtgttttgaaaacgacaataactcatattactcattatataaaactcccctctcttttagctatttaaaagccataatttatcatttaattaattattaatacttttttctatctttttactgtataagataataaacttactatgtgaatataaactttttaaatatgctttaaaatattgttttatatatttattagtttgaattatttggtttacattttattaatttacataatatttaatatgtatctatatagttgtattatttttatataactaatttagaagtataatctcttacgaatcatgtatgttttttttatttttgtaataataattttatataaaaacgatgtagcaaataacaattattgaaaggagaaatcttcattgtgaaaaattatcttaaaaattatgttaatcatataatatttatatgtattgcagtagaaatactctctttagtaattttgatttcaagaaaatgttccattgaaaatattatattgttatatatcttgccatttatattagtattatttattaccattctaaataattttaaggatagtaataaatctaatattgatgataaatatgaattaattgataccttggatctatatcgttcaaaaaatcaatttattcaaaaaaaagaaattaataatgatactatatactgtttttcatgcatcgatagagaacaaaacatttctacagaaattataaaagaaaatactgaaaatcatgttatagtaaagaaaataaatcattataaagcttatgttgaaatttataagaacatatatgataaaaaaaatgtatacattatttatttaccaaaacatcttgcacttacgtagaaaaactctctatatataattcaaattatatatagagagttttttctattaaacttattgttttttactgcaacacaagtcatttttaaatttgcactctgttagagcagtatatataggtgaagtattccagaatcctttatcagtagcggtttttctgttatatactgtttcacaatcatatatatacatgatgtcagaccatttaggattttccatttttctttctactttctttttattttttgtccaaaggatataatttaaacttaatatttggcataactcatgttctgatattatgtttttttcttggatttcatctatttgactacttaaagcagtacctacaatgcaaatagttttaacagtatcacttatatacatatttaaatctatagaagatctaatattattttcataacctgtattatcttcattaaatttaactgggaattgtttttttatagagaaatacatcttatattcttctatacataattttgattgccgttttaatatcagcaaattcaacttagcaaactttctcatttgctcttgcgttagttctttttctaacataatatttattaaattaaatatttgcttcgtatatgagttattattaataatctttttcactttttcttttttatcatctggaagattcattaactttttatttatatttaacatcattttaatcaccttattccattaaatgaaggcaaatttaaaatcatctttaatatttattaagttatcattatctatattattaattcctttactctcattaataacagctatagctgcatttaatgtagatataatatctatttttttaataatatctatttctttattacctatgatatctttcttaaaattatttatattattataatccatttctattaaatgctttgtaatttgtttatttaagttcatatatataacctgccttccattattctatacttaattattattactttttaagaatttagttatattaacaaaaaaaataagaaactttatttaaaaatttttaaataaagtttcttattaagccatattaaatctctaaaaaggtatgtctccatcatctactggaattatatcatcgtcaaaactgtttccatttccaaaatcttgtcctgattggtaacttgattctgatccattattatatgatgaatctgtggtagctttatctccccactcaagaaatttaacttcttcagctattacttctgttatatatctttttgtaccatctttagcttcatagcttcttgtttgtattctcccactaacccccataagttttcctttgctcatatagttagctgtagattctgcttgctttccccatactactataggaatgaaatctgcttctctctggccatcctttgaaaatcttctatctacagccaaagtgaaattagcaaccgctgttccattccctggagtaaattttaattcaggatctttggttagtctacctattaaaacaactttattcatttttaattacctccgcaaattatatatattatagttgtaagctttttaataatactttacaatatgaaaattaggaccatttaaattaggacataattctttttatatttgtgtaatcccctaatggtgaaatctttactacatctcctgtatgtggggcatggatataattcccatttcccatatatatacctacatgagtagctggatatccatgaaaaaatactaaatctcctgcttttgcttgagataatggaacatctatgcctacttgctgttgttcctgagatattctaggtaatgaaataccatatgcattataacaatataaaactaaacctgaacaatcaaagccttgtggagtagtacctccccaaacatatggtacccctaaaaatttagttgctaaattaactacagaattacctatatcatttttactattaactacagatccaatttttaaaaaatcattatattcagcatgattttgttgagctattatactatttgtattgcttgcattattaattttagctttatctaattcttctagcttaacctttagttcctttttcttatcatctatagttttaatatcattctttatagaagaagtattcttttctatctcctttttatcttttgacagtttttcattagtttttattatatcttgtttatccttttctaatgttttaatagtcgtatttccctcttctaacactattttcattattttggctttatttaagaaatcactcatgttttcagaagacaataacaaaactaaagcattgttagaattattatcattttctatataataatctctcatttgagcattcaacatattctccgtttcttttatctcttcttttttattctgtataaatttttcattttgtttaatttcattaattaatttagagtttttgtctttattatcatttaatttgatagttaaattagataaatcattatctaatttctgtatctcaattgttaaatctttctctgctggagctgcattaacaattggatgataaaatcctataatgcttccccctatgatagcactacataatattattttcaatttattctttatcataaagatatctactcctatctatatatttaaattgtattttttagaatttaaattataatcaaaataagaggtgattataattggaagaaatatttaaaattgattatttgttaccatgcgattctagtagttcagaaggatactctaaaagtactactgtagaagatgcaacagacaaattaaagctatatttatcaaataaatataatattgactttgcagatatagctattttatcctgcactccaatagaaataattcaataatacagatgagtaaaatccatctgtattatttcaatctctttatgtcaacttcggcctcttcaatttctaataccaatttcataaattctatattttcttttaactctggggtattgcttgaacatattataaaattatccaagcttgtgcttatattataattaaccaccattagatcattatcattaattcttaaatcatttaagttttcttttaaatggttaagttcactttgaattactttattatcatatattgttgattcagcaatacttatcaaaatagggattatagcattccttttttgatatatattttccagttgtttttgctttttacatttgtggttctctaaatattgcaacaatgtatagattatataaagtgaaaatattatcattaataatactgaatacataaaatcgtcctttctctagtatcataagtgacaatataataattttttataattattaccttgaatagtatattgataaggatattgtcttactcttttattagcatattttttaaagaattttttcgtctttgactttgatttttggtttttgataatcataatttatacctccaatgacattctttatataattatttatccattttaaaagttttggcttttataattctaggaggtaaaattattatttatattacatgaaatacccttgctataatggctataatacaagataaaaaataatatataacaaaagggcattctttatttttacgtttaaatatataaggatctaaaaccgatagtaaaagacctattaaaatacctatatagctataaggatatataaacaaagtaatagcaggagctaatttaatatctcctccccctattcctatttcatcagtcattaatccatatactaattgcaagatatacataatagcaaataaccatattgaattaatcaatatatactttattggtatttttaataatattgctattaagaaagctaaaatatactctattaaacaggtcctatttaatacaattctttcttttatatctctaatagatgccttatataagataatcaaataaatattagtcaatataaataatataatattttttataaccatattttcctctcatctcccttcaatttttacatatgcaaaaaattaaattataaaaacacttttgtttaatttttttaattattgtatatataaaaagctgtaacttataaattaaagggggaacataaaggatgatcagtccaactataacaaaccaattcaataataatattgaaatatgtaaaacactaaagatattacaaacaataaaagaaaaagatataaatacttataatcacagtgttaatgtagcaaagcttacatatgattattgtgtatattatgatttagataataaaggtaatatttttttatcagcattgttgcacgataccggtaagatttttatagatcctgttatactaaataaaccagggaaattaacaaacatggaattttctaaaatacagcagcatccaattctaggatatgaatttctaaaacaacataatatgggtgaatacatatcgcaagctgcattattgcatcacatatatgaagacaataaaggaggttatcctaaatttaatatagcaaaaccagattatatacgtttaattagcatatgtgattcttttgaggtaatgacttgtaataataggctttatcaaaatagcattaacacatcaaaagctttagaagaaatagaaaataatatagggattcaatttaataatagaatcgcagataagtttatatattggatcaaagatacacagtaacattactttaaattattttgtgctaccctttctacctaagggagtggtcctttcatacatttcttataatataaaaagagcaacagcacttatgactttaatcatgagtattgttgcccttttacctttattggatattaattttttgtattttcatattattttcttttaatattttaataaagcctgcatttacggccttaattccattaaataatattttcctgtcattatcatttaatggaattatattaacagtaccattatagtaagatatttgtgaagatcgtaatccatttcctatatctataatataatcctttggagattccaataatgcattaataacatattgctttgattgttcaaatatattattaatatcattggcattgttcatatctgaacaattattagctgctactggattagtattagtagatttgagaactttttttataatatcactaattttttcttcttctgttttatatttcactaattctattactgctacttctaataaagttaagttattataagtatatttactatcattaattttttcttgtaatagctcaatatacttaattaagttttctttatgaacttgttttcctaagttaatcataacctgtttttcctcttctatagttgctatttcagtattagggtttatagctaataccaaaacatttctaaaatatttctgcagatctttcattaattgatttgcatcttttttattctgcattacagctttatttatatgctgtaatgcagatatagtatctttcttaataatgctaaaagctatatttcttatatcttcttctatcattattcctagtaatgtagtaacattattataagtaatctcttccatagttctaacctgatctaaaatacttatagcatctctcatagctccatcagctactatagaaatcaactttaagcttttattatctatttttatcttttcatgttcacaaatatatttcaacctattaaatatatctgtaacatctattcttttaaaatcaaatctttgacatctagataatacagtaataggcaacttctgtggatcagtagttgctaatataaatattacattcttaggtggttcttctagtacttttaaaaatgcgtttacagcacttatagacagcatatgaacttcatcgattataaatactctgtatttacattctgatggagcatattgggcctgttctataatattccttatatcttctattccattatgtgaagccgcatctaactctacaatatctatacaatttcctgcatctattttccttgataattcattatttaatggttctccgttatcatgctgatttacagcttttgcaaaaattctagcagttgttgtcttaccgctccctctgtttccacaaaataaataagcatgacctatatatccacttcttacttgatttaataagattttggtattttctccttgacctactacatccttaaaaaatcttggtctgtactttaaatataacatcttgaaattcctccctaattttagctctacattaagccatatattctatttaaataattattatttcaaaattttaaaataccttaacagcacttagtactgttaaggtattttttcttagatataggtataatgtcttctttattgcaacgcaattgttttgatagcatatctatatataataactttataacttcataatttgaatatataacattttttgaatatataacatttttatattccattttaatatatattgttttatttaaagaaggcaaattatgaattttaaagtaaaaattgttcaataatgtcaactcccctaagcaactgttattgtaattgaactattattttttatttcttctttgcaattatcgcaaacaataattccatcaattacattattatttttcatttctatttttttattgcaaatgacgcatatattatttttacctttcaaaattaattcaccttcctgctttctttaatattttcattattaaccgctcctaattacagaacagcttaaaacttaattcttctaatactatattaggattggaagaaaacttaattctggtttcatttcccataaatgcaattagacttttgtctaactcttcttttgtaaaattattagatgattcataaattagtttacaataataaggattcttacctgtaaacttaacaaaattatctaaattatagttgtttacttgaaacaacctagcctcttgtaacatttttatatgatttaacaatgtataaaatacactaacaggtttttcacctttatctaataagttcttaagtgtattaaagtaaccattgacatctttcttactaatagaatctgttaaatcaaaaatatcatcatcattataagaagatatacagtttattatatcttctatatctaatgtatttttatttaaacataatagcttctttatttcttgcaaagctatatctatatttaaagttttattaacaaatagatctaacgcttcatttgtaatagtagtattgtgcttagcaaaaatactattgcaaactttttttacataatcagattgaaactccccatttataataaagaaatcatttttaataaatttctttatttctgagtttttattaatatttgttcttttatcttttatatatgaatataaaaaaacattagtttcatctggaatactcttcaaagcttttaacaagccatttattttttttgctacccctgttttgaataaaggaagttccattaagataactctcttactatccataaatgggattgtatttattatttttttaaactcattttcctcttcaatcattttaaaatccattttattaatatttaattgtggatttataatttgtgaacatagtagttttttagttttattaaaagctgttacattatcagtgataagtaaaatcttattactgtttattgttttaatatttgttatattttccatttcgtttcccccaacattctataaactttccaccaatttcatataacgattttttaaaatttcatttcttgctataacatctagatagttgctacaacccttactttcttttaatttatataggtcaacgttttcttcttcagctagctgcttataaactttttgtcttaaagagctatagctaatattatatttttgagccattttacttattttctcattagtaatttctctccataattcttttttataagaattatgagtttttttattttcccacattttttgatagtgtggtactaatattaaattagcatctttaacgcttaagcctaatttttttgatataaatataaatcctgttgctgaaattaacacgtcattatcttctaatttatcaccattaggtaggtctttaatatagttatcaattattagataactatttacagggcctccttttattaaagctactacttctctataatctacttgtatattgcaatgcttttttaacaacttggttattcctattccattaatatacttttgttcatttctttttaaacatataatcattgtgactcctccttttattcttttagctttcagccataacaaagcttctttagaattattattccaaaataaaaaaagttgcggttattccaataaccacaactttatatatacttttttattaaaatttattaacttactttctctatataatttcttctacattattaaaatctttattcactaataatccataatttttaaaaaatcctcctaaattatttcttatcagcttttcattttcttcccaggtatatcccaagggagataataagcattcatttcctaagaacaaatcagcttcataattagaagccagctgatatgctgttaacacatcgcttttaaatttaaatggtttctcatatgctttaattaatgtaaagacatattttttttaaaagatttatgcattattctatctaataaagtattaatacctttttttattccatacttatatatatttttgcatctaatattaatatattttagtagcggcatttcccactgtatatcaacatttttaagactatctaaatagccttttttgttatagcttataattaatttacctaaatagatatttataatatcagatttgcagctaaattctttttcccatttagataatagacctaatcctgatattgaaaattgtaatccttcatattatcctatagacaattgaatcttttttcctattactatttcttttgctttcatttcacaaaattcccattttaatattttcatatagcatcctcctcaattttagctaaaagccatcatttatcatctaataaattattattactttatatttttttcttatataaaaacagtaaaaaaaagagtaacaagatattatgtttaaatatcttgttactctttttatgaacaacatagtttaactaccactgtgactgctgtaattatgcctatcggtataattactatagataatagcctatattttgtttctaatagtttaaatcctccaattaaagatactattcctaatattattgccataataatcactaacacttaatattcctccaatattttagcttaactataagctatgctatattaaattataataaaaactttatgatttttaaatcatatgatcttacatagtcaaattttattttactaatttcaatgttacagaatctagtacaattatagttttatgaaaatagcaacaacactcgtgaccttagtaatgagtgtttttacacacaaaccaaaccttttctgaacttatatggtgtaagtaactctactttaggaacttttttaagttcctttaaagctatatacttacccttgttttgtgtaccttttactgtatataccttatcttcatacttaactaaatctcctggctgataaaagtatcttttagttcttattctcctttgaccttttgatacttttacacctctatattttctcaaattctctgaatttaaatttttgttacgagtcctacgtccattgaagagttctgctccacttactttggtattagttcttatatctattactttagcgtcataaaacttttcaagtgaacgagaattccttttaatttgctcaaatattaaaggttttactctattttgattactgcttcccgcaatacaaaaagcgtcattgtaatgtgtcttctctaattttagagcaattctattagatttagttatatatccataagtgtgcttacagcctaaagtattaactaatctccaccttatcattgacataaacgtagcttctttaaagctttttattttaggttgccaaccatataaaaagccattttctttatgattcttaggtgtatggcacttattacataatgttattaaattacctggacgatctgacctatcctgtttccaaaaaccaatgtgatgcacttgtaaaatagattcagcacccttgcttttacaatttggattttggcacttatggccgtctctgtgtaatatatattctcttaaattaaagaaatccttttgttcaccattttgataagcttctccctcaattgaaggattcttaagcttatgtgtatcaaaattagcaacttcaataattatattagttataggcaataacttcttcaatttgtctataaacctaatatggctatcatacttatgttgtatagaaggggctaaccactctttagaacgctttctgttattaaagcgaggcttacggtaacgtaaacgagatctacgttgtcttctatacatagctttttctttaagacgttctgacatacctttaagaagtttaacttcaccagaaattagttcgttttccttagtaatagcagaaaaccctatattaaggtagccgctatcaatacctaatgtaataggttgtacaaaatcttttgtattatatgaaagtttaatggtaaatggttttgaattaaccactaccgcctttttagatttaagtaaaactcttattttagcatatctgttggtaggcataagaggtttaccctccttatttaaaacatataccattaaaggcacacctcttttaattaataaaatagtttaactataaaacactacctcaaagggtaggtaagtccacatagccaaagttatacaaggtttaactagcagcaacactttttccagccctagaaaatgtttaatcactacccttagagcatgggacttgtggagtatcccaagataactatatattcttgtataacgtagtaaattaatacttaggctaatcaaccaagcttaataggattgctcctacaagcctacgaatttattcgtgggttagttgacatatggataccagatctttaaattttccactacaaaaaatgcaactgtatctcctccaagagctccccccgtaataaatgtatcgacattatatctttctattagcataatacatatttccctaatctttttagctaataattgatacttcttattgcttaactcataaccatataataaatgaggcctatgtgctgtaaaacatactatcattattacaaagccatcctttctctttataaaaaatgctaagttaattaacttagcatttacttatgtctatacttttatatctttggaaattcctccatacgttatttattttgtcttaaaaaacatatttatttcattttcttttttcttcttattgctaaaatatggtcagtcattcctattacagaagctcccaatgttatagtactgctaatcacttgagatgatttagaaactttagctaagagtattactgatgctacaaaaataaatgaccaacacaaaatcattacaatatgtttattaaatttcaaagacatattataccttcttccttaattttaatataaacacatattaaagttctttcaatatttattaattctactgaaatggcattaccactagtgtagatcggcaatctatttaaattaataatatttctctttttttattattatttcattcacataaagttcagttcctgtagcttatctttggattgcgaatttaatttttccctaatctattaatttttctattttatttattaaaatcatttgcctttcatttttttctttcataaatttaagtaactctttatcttcttctctattctcttcttgctccatttgtgaaatatagcataactcatgtgttgtaaatacaataagtccattataaatatcttttaattctctattcgataattcaactttcatctttacctctccaatctcttaattggcactatctacaatatttgtattatgcaactaatattctttaatatatttattacatacaggtttattccaaccataatttctgcaacctacccatctacagttttgacagctaggctgttttgtattagtttcatctgtaagttgcatatctgcatttaaccatttttgattagtgttttctttcatattttccactccttcaatttcgtaattatctcatttctatatataatctttaaattgattcatattcacctttagtcaattttaatcctccacaacaatctataattacatggtcattatagaccttttctgtattccacgtagagcctatcagtgttcttacaatttcatcttttttagttgtttctgtttctaaaattcttattttcataatatccacctaatttccttcacatttatttcatttctgggccttatatttgaaatacgtattaaaacgtattagaatttttcactataattttattttttcgtcttttatatattgtgccatataatataatcctgaattaaaaattacctcaatcttttctacatatttcaatggtactttcatttcctctccatcaccaagaaccgatttagtaagaacaagttcatcatttgcaatgctttttacaaagccttcaacacattcattcattttaataattttaactttatcattttcaaatacataagttttatcatccacaataatatatcttttgatttccatttttttcacctcaattttgattaagtcgcactatatttgtaaagacgaactatttaatatcttctaaatcatcaataaatctttttaacatttctatttctgcttttaaaacagagtattctatctctctctttgaacttttaaagccttcacaactgtttttttcctcaacatattcaacaattcttctttccttcaattcaagtttacctttataaaattttaatacctctttcatataaccctccataatttagttcataataatttcagatcctgcaactgctttttggattatgacctattttaataatttggcaacttcacaatcttttttatacccttgtatatttggatttctataccattatcacaaagttatcctttttttataagaaatgctaagttaattaacttagcatttagtttaatcatcaaagcctttagtaaattcttcttctgtacatattttattctctaagaactctcctttgtaattccaccatccctctattttttcattccaaattatccttaacgctttaatataatcttttttttcatttattgcaggatatacatcacattgtaaaatttgaataccttttgctaataattgtgtcttctgaatagacatttgatttaaatccccatttaataaatacattctttatcctcctcaaattaaattcgtaataattcagctcatgtagccacatctttgtattatgtttctatcttctctgccaacatatttataactaaatgaaaatatgtattcccttaaatcacattttttcatattaacatttctccttgaatttcgtatcttaattaaaaatactttttaattcatctatgctttttgtaaaaaatacagatataatctcatactgccaatcatattgaggtttttcattatttgttgttgtgtaatctaacatgatttcatgtacttgattctatctcatactcatattgaaatcttttcattattgcacttctctcttagaataatatttgaattgatacactaatcttctgctttatctaaattgctttgatattccataatactttcctccatatcagcaattcgctctttagctcttgtattcctttcttcatcattttctatccatgatagcattttgtcactttgatacttttctatagaactttttaaagaatttattttagattgccaataaattttatttgcatatagatattcttctttagctctatagccatagcttactgatatatggtttttacctatccacatggcagttttccaaggaaaattatttttggaaattcccgcatattcggcagactcattaagctctctacacgccctataatcaacacttaactctatattaaattcttttagcaattgttcttctattatatgtgacaacttgttaataaatttttctttagaaatactggctacagatttagtattcattacagcaaggcacgtagcaatttcaccgtttgaactgtcatctccgttatcaaatttagtatttgctactttatctgcccaccattcagaagctattttcgctatttcttttatacttttactcatttagatttcctcactctcaactttattcgttacgcataagtttcattagaagtagcagtattactgcttctataatcctttaatcattcattcccttctattaacaattttttatatcttgtatacactacttctggcacatatttttgtacatacccacatatacacctcaatgctatttgcatctttaattgagcatggaataatttccctatttttgaaattattttccatattattattttcaagttttcttaaagtatcaaaaatttcctgtgtacctataactccgtttttaacacatttcatttatatcactccctatatttagttagttcgtatttatttcagatcctgcaactgctttttggattatggtctattttaataatttagcaagttcacaatcttttttataatattcaagcataatatcatatccttatacttaaatattataatattttcttaatctttccaactcttctttactatatctatgagaaaaatctatttttttatttttcaatatacttactaaccataaaccaacatctattgaatctggattttttattaaatttgttgaatatggtatatcatagtatttttctttattcaatatattaatattgaattctcctccattatcattaatgcaatagtatatcctgtctatctcggctataatatattcctttctgtcatttataacatctacagaacaatgttttttcactactgctagcatttcttcacaatagttttcattatatattccccatactttcccgtttcttaatttcataatttttattcactccctatttatttttagcctttaaaagccataatttttattctagttaattattattgcgaaataaaaaaatcagatataaaaatacctgatttaatattctaagtccattctgtccaataagtatcagtttctccaccactatataatttattaaattcttctaatgtcatttctgactttaaacaatcatcattacagaaatactgtactccactatctatacaatatccctctgtcataactcttccgcaattagaacatattcttgtttctatttcttgctgctctaacaattcctgaaatttctttttattttctttatccaaaactatattagccaatcttacaaattcttttattgtagttgtattcatactttttcctcctaatcttagcttttatacgccataacttattatttgattaattattattacttttaaaaaatttattataatttgtccttgtaatatcttaaggtatatattagtataatatataaggagttgtaaatttttaaatttataacttttccttaaattttagcttaaagccataagaaagagtatttatatattatcaatactctttctttttttatattatacatagtgctattattaattaatttaattcatttttatatttctcttttttctcaacttgtttaaaatttttatattttgtatatataataaatatcacatcccccatcaaatgaaaaataaggtaccatatataattatttacatatagtaccttatttttatttgctttttctaacatctattttaatctttgtcataattctttgtgtatcttctttattcaaatcttttcttttaatcgcttcttgaaaaatatcgcttatagcatcccaatcacatattatatcttgttccaataagttttgtatttgttttgttctctctttatcttcactccaaaatttaaagtcagatagaaaatcatgaacatattctcttaattctataatagctgcagcaacagcatcttcttcagtgggtttattaacaataatatcaaagtctttaagaaacacagttacactcttatcactttctatatgtttatcatatcttatttctttataaatcaaattagcacctctattttctctatcttataattctcaaatgcttcactctattattttttgcttttaatactgtatctgtattattaggtgaatcctcattttcatttaaatctgtattaagagtataagtttctattgcacttttacggaaaaattcttgcattagtgatggttcaccattcaacttacgcaaattatttagactttccatactattcataacaaactcaaatatatcatcattagtatatgcccatagaaaatctaaaatattttcattaccaataggatcattttgattcaatttatttatataatcttttgtgtaaaaataatcttttgcacaaaatttatgtccgttaaagtctttttttataggaaacaagttaacaaattccctcggtgttaataaagccatcatatcatttaatacaaatattaaattaaaattatctatttctttttctttcctcactgcagttggcccttcagtattaacacttttaactccataaaaaattactttttttaataaataagtcttatcttcataatgtttaggatcttttcttaaagtatcagcatattcttttaaagcattgtaaaaggcattataatatattagatttaattcattattaggcttttttatcatcttaaatttactcccctcaatgtactaatagttctataatttttctaaaaaagatatactaatatattaatttaaaaagatccttttacaacaaaaataacaaatacataattaattgtaggtatctactttattatctaaaattactttattgtttaaaaattttatttcttgtatatataataaatgtagcaattaaaattaaatatttattccccctatatttaatttatccatccatacaaaaggggcttgcgactaaaattatgtagtcacaagtcccttattttaatataatttctatatatgatatctgaaattatagttaaacctataatttatatttttcaccatgacaatcataaaaattctttttgctcccacaaaaacaagtatttaatctcttattggattttcttcgcaatttatataattcaattttttcaagtatatttttcacatgttcattttcatttatttttccttcactgattgctatttttatattttcctttataccgggataccatatgtctggttttactaaataaattcctatcatataagattcaaatgctttgtcataatttccttttattaaatatacaagacccatagtaaaatgtgcaaccgaatcgtatttaatatttatagattcttcacacatttccaatgcttttttgtaatcacccttaatgtaatatgcaaatgctaagttatctagattttcatcctttcttaattccattaagggtatagattctataaacttttcttcagtcaataatttttttagcgcaatacgatcttctatctcattatcaactatcttaaaagtaaaagttatctcttgtttttcataccaaaatccattcttctttttatttatctctatttcaaatttccctgttggatatgaacctgtgcaattcaatatctcattaagtgctttatcaattggatgctcttcatttctaaatatattaattattttatcacaataatcatacatcttatcattaaataagaacttttgtatatatatcccatgttccctctcatatacattttttataatatctttactttctttattattaggccttattttaataaaatctaaatttataaaataagggaaaacacctaagcatgtactaagtaaaatattctcttcttcatcttttaatagtaaagttaattttgtttgctcttttggtgtactctctcgaaattttttcaaaaatccctcacaaatatctttatcatttatatctcttcctattttttttatcttatcttgcatatctttggaaataagacatggaatttcatcagttccaactaatgctgtatttaaaatgtctttaaaattttcttcatatttaatatgctcaaaatttattctatctggaactattgtaacaacattagaagtcatcaatccatgaattcgcaatcttcttaatccccgattactccatatattcatcatattattaaaagaaatattatctgatattctttctgaaaaattactatctatgttaagagttattttacctttactggatatctccatatgtaaattaaatggatatttatctacatcttcagacttatttgtaaataaatatatatctaattctcttctcttaacatttatttcaaagttaaataacatgtatatatctttttcatcataatttatatttggtattatccttaatgaattaatcacacctgattcgtttccaaagctattattaaattctatatcaggatcaggtaatttaatatcctttaattttatatttctactaagctctacagggacgccagccatgcttgcagcagccattatagttccgaaatctgtcatatctaattgtttttctttttttactgtagttattttaaaagttcctatagagttatctacattatcactttcttccttataaaacccttttaattgtttttttttacttttgacatgctttccataagtttaaaaaagtttaaagagttttcactcaatgaacgctcaatagattggactgcataaaaagtatcttctgttaattcatttggatatttaagaacatcaatggaaaaagcatgtagcaacccataatctaacgttactctacgatcagcacttccaaattcatatggagtatttctttcatccataaaatactttagactagttgggaaatgtgttaggacttcaattctatcatctttatcaccctcatcatataatacaccaaaattctcattcacatatatcataaagtgctcatttaaacatgcgtttacatacacagattttgtgaattctaactctaaatgacttcctataaataactttataagttctttaaatgaatctatatttctatttatgatatatacacctttttctctctcatagattatatattttcgagattgtaattcactaataacagcatcaacatctctttcttctcttttatttgaaaaatactcataaatcattgcttctgtaacactatcattttgtgccataaaaattaacaattcttcttttataacttgagatacatcaatatttatgtttatatcatctatattaatatcattatcctttaagatttgcttcacttgcaaatgtttgtttaatatttcctcatacatttcatttattgcattttctaattcgtaattgtatgcaactgcctttatattaatagaattattatatctattaataccagtcatcacttcatgtctttcgtgatgaattaaactttcattacttattcctaaaaactcttttactaaatatggtgctctttcttctaaaaaatctaattcatcagctaacctaattaatgcagataacaatttaattcttatattccctccttgtccatatgcctcacattcgtcaagtgaatccaaagggactactctatgactacaagctattctttttattgcattagcctctttcatatctaaacccaaatctcgcttaaattcatcaatgaaatctcctgatctctggttatgagaacttcgaattttttctccatatccagcatcatctataaacctactattaccaaccattcctatatcatgaactaatgtagctacaataagtaaaaacttttcatcatcatttagaatactaagagtttcattaaaacagataccatacaaattttctacacttaaagaatgctcaagtgtatgctcagtaaatgtaggatttacatttgttgttcttgctaacaagggtcttaccatattttgtatattttcaattcttagcttatattcttttgataatgaatccctaagtaaatatttttttctattttccattaacagctctccttttatttcaaaatactattgaagttctctataacatatttttattttataaccatattttatcatatagtttatataaataaaaaaatatgcttaatattttaatgaagtacattttatttctaaaaaattatatgacctctacataaaaatccatatttctaagattgctttcttgtttaaaaatcttatttcctgtatatataataaatgtagcaattaaaattaaatatttattccccctatacttaattttaatattacacattccccctccacatataaagggacttgcaactaaaatacatatagctgcaggtccctaatcattattctattattgtttttatactttttaatacttcagttattggcatattagtatctattacataatcacacggtattatctgaaaattttctttatcgtgtattattctttcttgtgcctttcgttctgctattaaatagttcttagaagtatttccatttacatcaatatatctttttatcattctacctcttctaatttgctcatctgctcttaaatataatactaatatttttgcatcatctatttctgatcttaattcattaactcccttaacttctactatatatatagatgttcccttatttttatattgctctttagtagcatagtagtgctcatctttatagcaagcatacgctattacattttctttaggataataaccatcatctaatatatcaatatcattcctatcatttatactatttaaaaatatgtgtcctctctcacctttatatcgtggtttcctggttgtatagctttctatataattatatccttccttctccaataactctgctatagtagatttaccggacccagattcccctactaaacaaataattatatccgtattgttatcttgcattatataattcctccttaatcttatacctttgaataaattaactttctcgaatttttatctaatctttttttaaatctatttatatttctttcattaccttgtaattctatagttaatttataattaaaccaactatatttttttataattatatttttaatacttacattataacttccattggctataattaaactacttttaaattgctctaattcttcttttttaccaataatgttcaaaatcaaatatcttccctcctatatttttcatcatttttagttcttaccatatacttttttaaaattattatttcaaaaataaaagaatcacacttaaataaatgttttcatgcaaaagagacaatttacattaataatactgaagcatttaagattcaatcgacttatattaataataagagcttagagattatattaatcaaaatgtttaatatacaaaaaactaggtatccttatatagattaaagaacctagttttagatattattttgattgtgacattaattatttgtattatagataataacttctttatgcaaacaacatttccgacatttatttataaaaaaataaagcgatgcagttaactacaccactttatttttattattattttaaatatataaaatcagatatttctttaaattctacagtcatagttgactgctttaacccattttttaaattttttgctatttctataactgcttctttccattgttctaagctttgaacaaattctggattagctgtacttgttatagttacagtatcttctccaccttctgggcatccccattctgtgttataaacagttttactgctatttattacactagaaatataaattcctctgtccttaaaaacctccaaagcaattttttgccaaacttctcctactacctggactccgtctttattcttatttttatgaaaatatccttcatttatccctgtgactatttcaaacttaattgtttttttcattttttcttcctcctctaattctatttggaaatctgacaatccaatattttctataacagcttctacatctccatctgcaaaatatacattatattttggatcaaacacatctgttatttctatatagttttctccaaaacttctatcttcccatacttctaatttttttgtttgtttattaagaactaaatacatagtttcatctgcccaatctccatctatacaacttatcagtttctttgcttgttcttctttactaaattttattttactcattttttaatcctcccaaattttttaatatattttttagcattcatatttaatcttcttttttaaattttctcccaaacttttaatgcctgttcttctgtcatttccattcctctaggacttccgcatgcctgtgggtgtccatcaaattttatgcctgctacttcttttccagcaaaagcatattgagattttggattacagtatattgatattgtcttatagtgctttctatatacaactacaatatcataatcatcctcatatgctcttgaaggatttaaattatcctgagcattaatagaaaataagattttattttcttttttacttcttacacaatctatataagcctcttctgaactttcttgtacttcttttcctatgtttattatattttctgttgaatactttaatatttcttctataatattagtaacatccacgctctcctctgatactctaggaatttttagattcctttgtaacctacctatacctagttgatataataatgctttgttatatttatctctacatatactagaaccattattatctatttgttctaacatatttagatctatattaggcaagtctttacctaataatcttaatattcctacatatgtatctgcatccatatgtgtaatttctatagttgaattttcttctgctacaggtatttgattattattacaagggcttggataatgttgaaattgaccatgatgatcaaaatgtttcacattgtctcccttacctgcttctattgaatatccttgaaattgtggtttacttgttaatattattctcattttatatattcctcctaattttagcttatgaaaagcctttgtttttaatttatttagcattttagcataatgccatataaactttatatatttattattacagaaaatagtaatcgtactaatttctcatttttataattaagaaattataaaaaactagaatctttatccttataacattactgttttgctataactaataatattaagaatataacttctaatattattgaactaatcataatttcatttattagtttttcttctaattttttattgcttaatttacttttgttgcccatattattttaatcactcctataattttagcttttaataagccgttaatatattatttgattaattattattacttttacgataaaaatttcttgtttaaaaattttatttcttgtatatataataaatgtatattcctccattttctaattataaagaaggtgttatatcatttcgcagatatagcaccttctttataaattctattttattttttaattaagcagctaatgatacagtatcatcattacttttaataaactcattcggataggaatttattatctgcctaattttagcttttatattgttattatttttagcttttttgcttttaataaccatattatatatttcttctctcgttgttttccctcccaaatattctataatattttgtattagagatctccaggttatcttttctacgtctaacatagaaaaaattcttttctttactatagtacaaggtattattaactcttgatctttttttattataacaagatattcatgctgtataggtatgaatttattagcatatttaatattgtctgaaacacaattatactgtttttttataataacattttctatttttccataaacattcatttctttaaacatactataataatcacctttaaagcgactatctcctatcagcagtgccattcttccacctttctttaatgctaaatagcttttatatagtactgtattgaaccatttattaaattgatttttatcatgcatatgggagccatcatcaatatgagctacatttccccattgctttccactatatattggcattttagaacccttaaaaacatagtatggtggatgtacaaacataaactcaaatgatttggggaattcatcctttattatattgaacccaccaaacttaggatttaaatccattcctaagcactttatatttaagtcctttgctacatctaaagatgttccactacctagcataggatcacaaaattcttttacattataatgtaaaagaatatcttttattagaagtccactgcagttacctctccagctattactaccatatttacctctggcaaaatactcagctatacttgttaatcctccaacctttttgaaagatattctttcttgtgttaaatctcctataaatttatctcccattttattttctaatataacttctttttttcttccataatctttaatatcaatatttattatatcctttgttaaatatggatataatttttctaatacctttccttctaacataattaatcctccttaaattttagccataatttagccataaattattgattttaattaattattatttcatcaattctaaattatatatattaaaaaagcataaaggtaataaaatctttatgctttaattctttcgttttgacttattatagtataaaattccttttttattaattcattaggaattttgtttgggccttcatattcgtgatactcctttagtatattcaatattaaagatccatatatataatctaaagtttcttttttgaatcttctggccttatttgtttgattattaataatcaaatcatcaataccttttccatatttctcattccactgtaagtaaattattttatactcatggaaccttttttctatggcatctgacatcttttttccttgtgtatatacttgaaaattaccaatcatatcagcatcaaagcaaatatatattggtatctttttgttttttattcctttatactggcaatataaatggaacttatttattgcttctttatattgctgcaatctttttatttctcctattacttctattatttttctccatgttgttactccttgtacactaattgctattactcctctttctgctaatttttcagctttaaatctcccttctgttattgctaaggtgggattattagttatttgactaggatatactacatctattggacttcctgctcctgttcccaatttgtatttatctttgttttcctctaaatttgcaaaggaagaagaaaaccaaatgtatctttgatcctgtttattcctctttttatcttttctaatttgaatacctactatttctcctttagtatttcttatttttatacctattcctttatattgtgcaaaagtatattggttcctttttatatcaaaataaaatcctggtatattttttaatattttttcattatatccacatttatttaacttatcaacgaattgattccatatctttcttgtagggaatgtaaaataatctctattaatacgctgcggagcaatttgtctttttgttagtaaatgaatataatgtgcactatatatatcacagcagcttgtaaatatttcatatactttatttaaagtatatgaatttgctttaatgctcttctcattattagtttttaccatatattttttttgtatatttttaatttcttttgctttatactttcttttagaaaaatattgttcatattctacactgctaataagattaaattctaatcctatattaaatgcagcttctacataatttactttatcatgcagtgatataaattgaattgcatctccacctacattgcaagtaaagcatttccatattcctttagatggagttactataaaactaccaattttatgatcattatgaaaaggacatattcccatataatacataccttttcttattagttgtattctagttcctataataatttctaaagatatagactttattttttctattaattcttcaagaaattgttttttattcatattgatttccccctaatatttatctatttaaatatttcttattccatttaaattttttagctataattggccatataattcattcaattagttattatttcaaaactagaatctttgataattttatatttaaatagatttattaggttattagttattgatataattctatatatttacaatatttctattgacaaatcgacctgaatgttatatatttataacataagataaaaatatataacatttgttaaaattatataacaaggagtggtacttatgaaaaatatattaactttaaaagaacaatcaatactaaataaaggtctaattggagttatatttattattatgggtatattacaattgtttagaattaacccaatattaaaattgatattaggtgttattgcactaattggattatttttatcttgtcttcctgtttttataaaaacagaatcagaagatgaaatggctgaatataacaaaaatagagctagcgcaactatatatacagtattgttaatagtattcacaatctgcgtattaatctctactcatacagatcaatggacaattaatttaaaaataatatcaccatttttattaggtggatttaatttatctgaatgcattttattttgtatttatgaaaaggtcggtgattagcatgcccaagttaaagaccaaaattcatgaactacgtaaagaatttaacttaaaacaagaagatttagctaaattagtgaatgtaagaagggaaactataggtaatttagaaaatggacgctacaatccatctttaaaattaggaatggatatcgccaaagtttttgacaaatcagtagaagaaatatttgaatttatagaagatgatgaataaaataaaaaaacaacaacaaaatccatttaaagctctttcctgaaagtaaatcaacctaatcaatttttagctatatatcattcattcaattaactattattttaagaaaacaaaaagtgataattagatatttgatacctaactatcactttcatattttttattatttaattttattatttggaatttatatataatttctcattatctcagtgattttatctagatcttctcttttaatagcattccatgtgaattttttaagtttatcaattaaattatcataatatttatcttttttatatttttctatatctaagattataaaagaagattcacctgctccattcacttctcttaaggtattcttaaaaaatctcttttttttgcatgcctcaactgtaatatatcttctacctactgcttctattattgtttcttcaattttcgatgttctcccttgatatatacatacccaaactttttgaccttttcttatctccatagtctaataaccttcctttataataacttcaactcctgcagctgctatttgaaatacaaagcaaacaaaagcaattactttctctgatttctacaccctttctataaggtaaacctgtctttctaactgttcaaacatttatttcttttctgctttgtataatactatacaccttccttataacatatttaattgctcacagtatctgtgattatcctcctatgtttcataatgatttcagaatataattgtattacgcattaagtagttctggattatcgtatatatttcctataatttcacattgataaattaaatcttcttcgcagtcattctcccaataaaactgagataatgggtaaacatcatcattccagcaattttcaaattggtcatacatatctgtgttatctgaacatcttactaacataaaacttccaatttcaaatttaacggagtatttgtgaccatttattttaactatatctctctcataaatttctttgtaattcttatctttaaaacctgtatattgtcctaacgattctatatctacagttttaacaaacttccatttaaattcaccttgttcaatctgtatcccataattaccttttatattcttgcataaattgccataaatccattctccatttgcagtatcacatccacgatatttagtttctctcataaaacttgctccttcgtcttataatcagatcctgcggttgctatttgaatgatgaagtatttataaatcccaacgttttttgatattatttaacacttcatcattgtctggcagtcgaaccaagttatccatatcgtaataacctaattcaatatattcttgaatatattcaattaatatttcaagtgccattctattacatggatttttaagtaatttcattagtctttcatcatcataatcatggctttgacatggtccatatgttgaatgaatataattaaaatcttttagtgcttgttttcttaattctaaagccttatttttctccataaatatgcctcctttgatactgcgtaatgatttcaaattgtacactttttttgtattatgaaatatctatttagttgattaattaatcttcctcttgaaaattatcaaagatctgttcttctaactcaatacatttaacaccaacaggataacttcctatgatttcttttatctcgtttcttgtcctctcttgaataaatatatcatcacaaatcttacatttttctacagtagcattactgactttatattctttattttcaaaaatgatatttatatttttacttattatttctgtatttccaccgaaatgacatattgaaatttcttctttcattgcatcttcaatcaatacaaaagccaaaaattattcctataatatattcttctttcatagctaaaaatccctttcttttaaaatattaaatatatctgtaataaattattttaattgtacaatattttttattccaattggttcatatagttcataccattttttttcatctttaattttttgagtataaaatataactttatattcttttccttttgttcgcactattccacgagattcatcttcaagatttatatacataaattttttatttattcctaactctttttctatcaaattttctgccttttcaaaatttttattttctatttgcaattttttattatagtaattaattccaaataatatactcataattataacaattccaattactatgtgaggtatatattcaaatatcaatctatatttcttaaatttattgccattcatattatttcctcccacccagtaaataacttaaatatttaatgtgctttaataacctgttatctcaatcatacaatacccttccttccatataatagtttgtacactttctccttcggaatgatttatttctatttcaaaaggttcttttctagtattatattttatccaaatttaaaaatattccataatatttttaaatatattattatttatcttctttcttcttatatattgtaaaatttaaaataccatataaaaatttatataccttataacctataactaataagaactttataaatataggatatatataaaatactggtaatataattcctaataaaatatgccatacttttagtccatgattttttatatgttttaggaaatcattataaatagattcttcatccaataataaacatggcgaaataataataaaacaaactaaagtcataatattaattgctaaatataaattttgggctatttgtagtttattcataaattaatcatgtcctttcttttaaaattgtactaaagaatataattcatctttagcgtcttgatctatgcctatatatttcaaagttatttttctgaggaataattaaatgtattcataattaatcctatattataacgtgaagctttatatgtgcaatagccccaagttttccttaacgaatgggttccaaagttctctatacctaaactttcggctccttcttttaaaatcctataagcttgtgtagtgcttataggactattaattccttttctactttgaaaaatataattattctgttctaatttattttgctttcatattcttctatatgcaaaaacaccacataatctactgaatagcccggtgttttaagtactattctttatttaattttccaggaactctttccatagaagatttagcaattatataattttcgacctgtttttctgtattcataaggataaaatttatcatttgctatggcttttcttaatgtactatagtctagtccctaaatggtatatctaatgcatctttataactccatttatcagctaattccattcttgttaaattgataatataattactatcttcaattaatccatcacattctaaaatctgccaaggtgtttgagcttttaccaattgagttgctccacctttaaaaacaactaaccatacaaatttactttttgccatcttatcaattcctttctttacaatgattttatttctggatctaatttttgaattgcgtaactatagatttacaacattagcaatataaagatactgtataccctccttaattacatattattattctgtccatactgcactcttacaatctattgcatcagattgactaccagttttaggattataaagttgaggtattgcttctccatttttttctacccaaaaatctatttcatgtatttttatatttttattatcattcttgtgatactcctcatattcttttgtattaacaaaatccatcatccatccttctttatctccatagggaatttcaaatatattatagttttgaatagggaaatgctctgcaacacatcttttcaccacttttttcaacatttcttttttcaacatttcctctttatattcatacaaatcatcagcatcaataatctcatgcttttttattgtactattttcttcccagtatgtaggatatcccttatgcatatattcccatgaaatacttttgcaaatttgaataatatttttttcctttttcttcttaatccttttattcatcttttctcacctttcttatcctattcattactatttgagttttctattttcgaataactacaattaggacacctgtaaacacgagtgcttgatacaacgggtaaaaataccttatcatatactaaaagccccaaccctaataccataattaatatacatatagctgctaaataatcttccatacatctctctcctttaaattaaatcttagtacaataacctcttatttctgtattctctaccttattagtactaatttctttatttctgttatctcataatgtgtaaatcttatttctctatgtttatatttagcaggtaatttatatgtcttagttactccgactgaaccaaaaactgccatgtattctctaccatttaccactacttttgagctgtaatcatcctcatcaattccctcgtagctgacttcatcatttatataaatactattacgacttatacctaattttttctctataagttcatattcctttagtaatcttttcttctttgcatcttcatgaacattgtcagtaacattacgttcagctgattctagttcgtcttgttgttgctgaatttctttatttttcatatactgcttatattggtatttaccgcattttactataccagctatcatgccaaatattacaattagaccaatgatctccattactttatcaccagtggttattttttcattttccataatatcactcctaaactatgttattgatacaataaacccttaagatgaattataagtattgtatctatagtttttttaattgtaacttaattaaaatatcttattacctgttctccaacccactttcccataggaacagcaacagcattacctacttgtttataaatatccctgttactacctgcaaatttaaaactatctggaaatccttgaagccttgcgtattcttttggcgtataaggtcttacccttttaccatcattaataagtcttgtacttaaatctttactataatgagcaacacatgttggtgctactccttctggtgtagatattataggtttatccctatatgctccgttgagccttttataaacataattaggtatatctatttccggatcatcttctaataaatcttttagctttattggattgctttctggatattttaagttatcaaatggccttttagtgccaattaaaattaatctttttcttttttgtgggagccacatattagcatttataggacattcaatccttacataataatctggtaatcttgtaagagcttccattaccactctaaattttttcatacctggaacattttctacaatgtacatttctggtcttgctagtgctacatgcctaaaaaagtgtaaaaataaatcatcaccagttctagtaccatgtatatctgctatagctgagtatttagtacatgggaaagttccaacatatatatctgcatcctgttggtctaatactgtaattttacttatatcttcttgatgtatttcatgagtaaaattagttcttaatgtattacaacaagtagaatctatctcataagaatgtgttatatttatacctgcttggactaatcctaaatccattcccccagctccactaaaatagcttttagctgttatcatttcatcacctcttttttatatctcgtatacattcctctacgaatttcttatattctttatctactgcatttattagcaatttaactatataactaataatttttactctttctctactgcatttgctatctatattatgtgatactaataacttaatctttattggcaatctttacaataacatccatgtatattacattctgcaacattttataagtgtacattcattacaatcttgcttaattatttgctgatcatcgtcatcattttataataataatgaaaaaacattattccaagtacaatcattgaaataataaatcttccgcatttttatttctatttaatataaaattattttagtttctagatttgatagttgtattgtaaattaaaccattctttcttctgactctttatatatctgttttatttcagatttaggtatctttacgtaatagtttctatacagcatttttttttcttcatcttttgtcacataaacatcaaaatgcttatttttaattttgcctttatgcatgatataaaaatcacctttatcagcgcagccttctaatgggttttcacttctatcatcccaactatggtcaaattcaaccatttctccatcattgaattccatataccatttatggagtatatgtttaaattttcttatatcacattgaattaaagagttataagccttaaagtattcttctgtatagccataatataatctacaaaggctatcacaatatttaatccacatttcattatctccaaaattaggtatccaataattttcaacatttgggttaaacgctggaacttcatcatcaatagaatattttaaatacatttttaaaatatatcttgatttatctgcacaacatgctgaaccttctcttaattcacataaatttcttatatgattttctaagaaactataatttgcataaataaaattaggtttatttttatccttacaaacagatggcttgtgtaatatgcttgctaatagttttataccttttttcaatttatgatttataaagcagtcaaaatattcaggattgtttatatcaactttactttcttttgcatggttaatcgcatcaccaaacattttcattgcttcttcttctgattttgcattcaatgcatcaaataaacttgtaagacatttagtcatttcattattcataataccactccttaaatctttttcgccctgtttaagaattccgtcttcattatttcattcctggatctaattttaaaattatggactaacttgctaatgtatcacaccatctacaaaatgcttttaatataagcgctacattagcatcactaaattctcctccgaatccaataaatccagtttggctaaatgtaatgccttctctgtcatcaaaatagctgcccttaattcttaatcgtgcatattttaagccactttttttaagtacttttacatctttaactctttgttttcttacttccatacccatctgttgagcatgaaaacctccattttctaaataataatttaattcctcagataaaatttcagttagcctttcaatatcttccttcttgatcttgctataatccaatcccttatttttaaagtattcccttgcttcttcacgctccatttataaatcctcccttcgtacaaatttcattcctggatctgttctttgaattgcgtaatattttaaatataaaaaaataccgcatatcatcttaaataatgcgatattttaaatacctattcatttttatttacactaaacacataactcagtctaatttacgtaactcatgcgaatcgtatatttgttcaaggttccaagccatatcattatactttttatagtttaatggagattctaaataaaaacaattaaatatatttctaacttcttgaaataatttttttgattttttcaatttttttaagattattatttctttctcagtcgatacatctgcaaaagcactaaataaagctatagaataaaataactctctaattgcacttattaaatcaagatctttatcaacagcctgtaaataattaaagatacgttcaattttctcttcagattcctctgattcaaaggaattaaatttctctgcattttttctatatgcataatattcatcaaacattatccttgcaagtttaaaccaaatatcttttgaataatatatagacttatattcctcaatccccacataatcaacaatatctatattgcttttagcatgaaaaaactcatgggctaaaacatcagcgaatttttcacattgctctatagtatattcacgtactcctccaccacttccaatacctaaattgattgatgctatagatattattatttctattccgtcatctttaacgtttatttctgtctgtccagcacaatccaatacattcattatttttattttctttatatgattctcaattcctactaattcataaacattacgcccttttttaaaatattcatctttattagaaaaagatattgggaatctcacctgtttgccatctacataaaaacacattaactgctcaaatgaaggtttatctgcagatattgttgaattgttgtcacaagtctgtaaagcatttgttttgtaattaatacttttcttcgccaatttgctctgcataaatatattttttaactttatcataactattctccccatatacctgtttattacatgattggctatattttgattactattcacaatttaattatatcatatactttctaaatatcgcattattcaattttcaaagatcaatttttcactagactatattaaataacattttatctccttgttgtctcaataaattcatttttggaccttatctttgtattgtaacttattcccactcaataccttttagtatattatctatttgcataatttcatttacggttaagttcttataaaaaacttgacttgtcttatgattataaagtcttatttctactgcactctcttcatcggcttgaatttctctataaccacataaacatttatatacacctggttctatttcttttatgtcagttttgcatactggacattttttcattttaaccaccttcctagttacataatatatttcattcctggatctactatttgaaagaacacttacttatttagttgtattgcgcactaagttaactcattgcctgttaactgataataacaaggtttttttatttctaatttttcagctttatttatatcagttgttattataaagttttctattaatttatttttaggtaaactaaatatgttttctgcagctttaggattaactacaatagtaaagtcataatctactaaaacctcaagcatcataattgctgtttctaatttgtattttttcattttatcttttaccattttatttttaggaaactctataactttcattgtttttaaatgcatatctttcaaaatatccctccatatttaaactaaaaattaaaataacccatttctctttgcttttataagtttaaatgcattttctatagattttgaatctttctccgttacaactattttttctttagcaacatgattattaagccatactgtttcattaatccaatcaatttcaatggtatatggaatttctccatagtctttagtctccatagttctacctctacctaattaaatccatatcataaattgtataatcgcatctatatattaatagatacttaccatcaattaatattcccgtactttttggaatgtctgtagcaaaataacttacattatctccaacaaatgttgctaacggttttccatcttgggatcttattaaaatcaccctttttttccctgatgtaatattcttataactgtctacaatatttcttaaaaatggacgtgacttgtcctgattaataatttctgtagtttttaatgtatctttcattaaatcttgtaatccatcttcttggagaattaaactacttccaacgtgaattatttgattattaccaactgttatatttaatacacttgatttttttattgtttctcccttttcatcctgctctttaaatttatcatctaaagatatacttatacttttaccctctatcctatctaatggtttactttctttgtcgtatgttgttattattgcattcctacctttaaaatgctcttgcaattgtttatattcattttccaataaattgcaaccagaaacaataaataacgaacttactaaaactattgaaactataatgcttttcatttttgttttattcattctaaacatccccttcacaattccacaattcatagatctaatctttgaattgtggaattaaattattttcaactgtttacctttttcaagatgtaattttattctttccttagctttattgcagtacttcttttctttctctatacaaatataatttctatttgtatttatacaagcttcagcaagcacacaacttcctgcagtaaaatctagtgcgataccttcctcatttgtataagttttaattaaatattcatataactctatcggcttttgagttggatgtatcctatcttttatcttgattgtgttatatggaatatctattacagttgttggatatcgatctgtttgacctccaccttccatacctattttagtcttaccatagttggcacctgcggtagtatgctgcttatatttctttactggcttatgtccgtaagtcttctgtggattatagactggtaaatttttataaaatatagggatatctatatgttgtcttaaaggcatcctattagcatttaagaaatttgatttttctttaggcttccatatccatgaatacctgtagtactttttatttgaaactactaactctgatgtaaatactccagccgccattaatgctatagatgcattatcttttgcaattctatttatctcctgccacattggctcaaaaggaattgctttgtcccattcattattagtcattccaaatggtaaatctgataaaaccatatctattgatttatcatctatttttttcatgatttcaaggcaatttcctaaataaatattatttacttctagcaatatatcaccttcttttctgtcaccttaatttcattttttcatgaatactagccaatgtgtctttgctcttttatttcccaatagaggtttataatctataacttttaatatatcttttatttttatttgttcttcattccatttaaaaatcaatattccgtatttatctagaaccctcatgcactcattaaatccttgtcttatatctattggccaatcactatttaactttccatatttcttggccaaccatgaattttctccagcctttattaaatgtggtggatcaaaaactactaatttaaaggtattatctttatatggtatatttctaaaatctcctagtatatctggctcaataataagctttcttccatcacataatgtatcttctaactctctgttatccataaaaataacatccttattttctttatcaaaccaaaacattttacttccacaacatacatcaagtattggttttcgcaaatttatcacttcctaactattgcacaataatttcatagattataagatacacctatgcttgaattgtggcattacatcattgcttctaaatgtaattccctatacatttccgattcaaatacccaatctccaatatctttatcttcaaagtcacaatcatgcgtattgtaataatattttccatttttcaattcaatgctacacacttcactttcaaagaatctataatcttcgtctatcatataggcaatatcacctaattgaaataattgttttgtatttttgtttgctttttctattaaattctttagctcattaaaccttaagtcaggtcttttggtattacatagagcaattattttatttttttccttgtctaaaataaaagcatctgtaggattttcaattacaagttcatactttttcatccccaattcactcccttacaataacttcattcttagacctatttttcaattgtgacttagctaaatcctaaatccaaaattgtccattgttgcctgtatatcaccattaaattgaaaataagtatacaggctgctttccttggttggtactgctccaaaaaactttaattgatttattaaattaccttcttttttattactgaattgaacttctgttttattttcacctattaattttactttcattttatcccctccaaacttacccttttatatcttctttaaacattttataagttaataatacaaaattatctttcaagatgtttacagaaattatttcaagattttgattcctttttatgaaatcttgataatcatacactgcttctaacactgttacccctgtaaacaattttgtttttatcattaataatcactccatttatttactttgtatttatttcatagttttaataactctttgaataccttttttaaaaatttaagttgttctttattgaagtggtcttccttaaaactatttcttgagccagcacttataataattccaatagcaaaagaaagttcctcagtattaagagtattaaaatctaataagcaaggctctgcatatatagcgttccatatctcatcttttcttttaattgatatcatttaattttctcctctctaccttttattagatttattttgcaaattaatctaagtttttacttatgccctgtttttgtcttagaattcttatttttaattaatatactggtattataatttttattataaaaaacactagtaaatttaatataaaatttactagtgttgtatttctttatgataaaaattataatatagctaagagaataaaattatgatatcataatcatactgtcacttatatcattgatagtattaatcatagtattatcaatggttttacctaaacaaagaaaattacaattatttacattgaatataaatatcttttttataaaaataaatttaaaaatttattacaaaaaataaaaaagtgtaaatacataccttcacaaatgtatttacacttaaactgagaaatatatcatattgttaataactaacaacttctttacctacattataccttatgcatttattaaagtaaatgtggtattcattttttatttaagttttctatttgctgataaattaggagcggctaaaaaagatattaattttttatacaaagaggtatagaatagtctaagtatgttataaagaccattccattactattatttgcccttatcttctataactttactatctaagtaatgttaatatatagtttttatcattttctaaactactttgtaataatattgcattagtattaaccaatatttcatttttacttttctctactaattcttttgcaatatctatactttgaatcttatctaaagttgttccctctaatatttgattattttgctcaaaatttaatttatattctaattcattagttttaatacctatataattttgataattatttagttgatttaatactttttcttctataatattagaaccatttaatatatctgatatatcaaatgaattatattcttcatcagatatgtatagattaacatctttattgtttatatcaaaagtaaattttttgtcatctggcaattcgaatactatttgcttatttttattattgcttttgtcattagcaattatttctttaaattcatatactgttatttctttagaagtatatgtcatacctgaattatcctgtatgtctacaatagatgtacttcccctaaatgtatgatcatttttattaattatagttgtttttatgctatttaaatttgtttttaatgcatcttccatagtagtttctaattgaatattatattctttatcattaatattaatatttcctattaatttattgtcttcttcttgtaaatatcctttcactcttgaattatcatttattttcccattaatagaaaacattttatttacattattactaacattaacaatatctatatcggcattgtttttatagccatattcactagtaaaaaccgtttttatattgtgcttatctaccatttctgattcataaaaggctatcttatttgctttttctaagttatatttttttaatatagtatcaatttcagtatcactaatttttatagcatgtgattcatttgaagatttattatccccaataaagatgctgtctcctttagaaaccttaaaatccattagttttatatccatattatatgcgcttccttgaatatttaatttttctccagtaaataaattctttccattaaatttagtattttttatagtaaaatgcatgttatctagcaatgatcttgcttcatattctatactctttttatcatcttcatttaaagtattatttttatatattaaagataattcttttaatctagttccaatttcttttaaatcatttactgcattttcttttacttgtagtaaagatattccttcttgaatattccttactgctatatttctagatctaacacttgtattaattctacttatccttcctatttcagaaggactatcggctgcaacatttactcttttattagttgataatttcatagaatttattgtagctaatttattaaagtaatttatattgttaattaaacttaatttattcaaatctatacacctcttaatatttatttaatgaattattatttcataaataaaaaaacaggcatatataactaattttttataaaaaaataaagtaatttaaattactttacttaaataagtcttataattatttgtttaaaattagatatatcaataaagaattcaccaaatgtaattattatcaatacaataatagatatatatactaaaaattctattatatattttttatcacacacactttctaactcctttaattcattctatcaattataagattattattacattctctaaaaatcatattattttgttggatttattccttaaactatactaaaatataataataagaggtagacctaagcaaaaaatttataatggaaataaagtttaataaaaaaatataagtagataaaagaacaaattatgttaataataaaaagatacatatatagctgtaaagtttattaaaaactaaaaaccacgacgttgaaaggaggaaaaagtaaaatctatggatataccagatatacccgaatatttaattgaaactatatttggaaatatagatcaacggctaaaacaaaatttctataattatgaaaatttatttaatatgaataataaagaagaaaatttaaaattattaataaaagatattatacaaaaagaatttatggtagctgaactaaccaaaatatcagatatggatttacataaaacaaaacatacttttatagctcctgataaaataaacaaactaaagagatataatttacaacaaataaaacaaactaaaaaaagatggtataattcattatttaaaaagaaaaaaacaaatccatttaacattgaaattgaaactgctaataataatataactttatatggtcctgaggtattttttaatttatacaaagttagaagtattgaagaattaaaagatattagagcagctcaatttaaagattggctagataattctatatttattacagatttcttttatttaaaaagtaagacaaataagcagattaacacagcttttaatttagactttatatataatatctgtacaataatctatgataaatggaataacaatttaaactttatatatatggagtacccaaaattgttattggatcatcctttagttgcagatgggagcgggaaaattaaagtacataaacaaacaattattcagcaaaatcaatctaataaagatgttaaatataaatacaacgattatgtctctaaagatggaataactagaatattagttcctgaatctaatattgatactaaacaaagtagacttatagacaataaagatcttaatatattatctaatattcttaaatataaaaaagcagattttctgaccaataagactatagtttttaatttaattgatattataaataatatttattgttctaaaactgtccgttcttatgaagatttaagaaatagaattgcaaaaatgacattattgaaatttaatttttttagaacagataatacttctggcatccctgatgctgtttatgggattttttctagttacgagtatttagataaatctcaaaacagagttaaagtttatgttgatagtattttatatgataaaatactaaaaaatcaagtatatacaatatacaatgataaaataaatcaattgaatgatgattttgctaaaacattagtaatatatcttcaacaagaaaagctagtattatatactcaaggtaaaaatacaactttcttaagttatgattattttagtaatttagttagatttagatataaaaaagaagaaagaaactataaaatcattgctcaagctctagaaaatatgaaatgtaataatataattattagagattttaaaaaacatatgaatggatttataataacatttttagatacaaatcaatttgaaatttccgatttattttccaataaaaatacaagtgacataatccccatgatataaataattaccaaatactcccctacctatctggtgtgggagtatttttttataaagaaatttattacaatttcaaaaagtgtttcatttctatcgtgcactttttaaaaaatgttttatttttatcgtgtactttttaaatacatttagtattttttataagggaaccaaaaagtgtttcacttttgtcgtgcactttttaaatatatcattatctattcctatacttgtcctaattcattaatttttaagaaaaatttgctaataaaattcactaattttttataaaaagtgtttcatttttgtcgtgcactttataaaaagtgtttcacttttatcgtgcacttttataatttattattttatacactattataattgaaatttatactatatcttataaaaagtgtttcatttttgtcgtgtacttttatgatttattctttagttattttattatatttaatctcaacactagtgattatatagtgttctaaaaaagtgtttcacttttgtcgtgcactttttttataatattaggttgttgtatttactttatttgttcaaaaagttgtttcacttttgtcgtgcacttttgtcattagacaaaatttattctatttgcaataataaaaaatgatctaatatattacagaaaggagcagtattttacatatggcattagcaatagaaaaacttttttttaatgtaagtaaaaacttaatacactttattacagagccaataccattatatcactataagacaatttcatttaataaatgctgttattgtcctttctataaaaaaatgaatgataaaaacatacataattattgttctaattattgtaataataaatataaaaaagtcataaaaaaatataacatttatagtaacataaatattgataaggcccatattcaattttctttaacacaaattaaacaaatgctaatttattattattatgcaaattctaagggattcgtttctttgatatctaaaaaaagaattgctaaaatgataggttgttgtgaaaaaacagtagatataaataataaattattttcagatttaggtttaattttaattagcggtactataaataacaaattttctttaattattaaagattactctgaacactatagtaaaaacaatgcagggtatcttaatttggctacgaatgtttttaaggacttactacatatcaacaatgtaaatgctttaagaatagctctccaaggcatattaaaacatgacataaatactattttagatagggaaacttatttttctattaatagtatgaaagcattcttaccagagtatataaattgcaagtctgctatagaaaaaataatatgtaaattaaatagcaatacaataactatgctttttaacagctctgaaaagcttatatttgttatctctaaaaatctacatggtaaattactaaaaaaagaaatgtattataaatataagaataactttttaaattatattacagaaaacaatattaaattaaataatttaagtcattctattaataatattgtaaaactttctttcgaatacgggtatgatattgttcagttaatgttaggagaaataaaggatatagcaccaactatatttaatgttggtggatatataagagataaaataaaaagatacatttatatgaatgaacctttttttgcaatataaattaaggtctttttgtcatgcttatttttaaattttattattcattatttacaaataatataaaaacttatatgatttgtaatataagtttttataaattgctctcattagctatttatttccattcactgttgataactttggaaaaaaatcattaacatagataattaaataaattacactaataataaaaactattaacataaatacttaattttcaacattaagaataaaaacaattctaacaatttatatatctactgatattactatgttctgaaacaaatatttatgattaatatttgtattttaatatttgttctttaatagctcttttcatctctaaaaggaaagcttaaattttctatatttattaaaagccttttattcagcttaatactatataattttctatatttataattgcatttaataaaacacttaaaagaggctgtaatttagtttataaaaactaaattacagccccttttataaaactaacttaaaatcagttgtaaccaataatgagtttgtctcattattgacgtaatataatatttccattcttaaactgcctccatcttcatattctttttatctaaacctttctctattttacgcaagcttacaatgccaatccctttaaactgatatagttgcttttttgaatacattgatagatcttccaatgtatttatacccatatttctaagtgaattataggctcttattgataggtttagttctcgtaattcatctcttttgttttttctcattttcttatttccccctaaaatcatattattttgtactttatcttagtagctagacctcctcttagatgtctttcagatttattataatctaatactttttgcacctctttagctacttcaggattgattttaggtagtctttcggttatatctctgtgtattgtactttttgcaaccccaaatactttagctgtttttctaacagttgatttagtatttatcacataattagatacatccaatgctctttcctttatataatctttcatttataaaattcccctttcttttagcttttgccaacttctttatttcctaataagttattattacaaaaataaaaactaggtatatattttatatacctagtttcacaaatttatttttttgtaaataagttgttatcatctattctttccgctattactttaactacttcattgaattcgtttaaagtcataatattttttaatacaggcttccaacctttccttaaattccatattgaaatacagctattcattccaccgccatttaaatcttcattccgcttaattcctttagaacattcacatttttctataaatccagtttgtttgaagtaatatatatcacttatactggataaattcgttttatattctaataattcaatatattcttctgttactaatattttttgattactatttaatttgttaataaaaattttttccattcctacaatccttcctatctaatctgatataatttttaattttagtttttaaaccatataaatatataaattattattgcaaaaattacataataagtaaataaaagtattttttttaaatacttcaatatctattgtgcaatcttttattgttctatattaatattacgttaatgctgaagggttactatatttaatttttttaatatagtacttttcttattcgttacactttattttttatttctaataaagtgtattaatttaacttattaatgctatattattatactaataatgattaataatgcttttatacgtgaactaatataaagatatctagctattaaagtttacattatataaactatgatatataatcttaataagaaatattgcaagaaaggatttaataaatgtatgagaatttagatattttccaatttggagagtatattattaatatttttagtgaaaaaaagtataaagaaattgatgtgttttttaatgatatgcatatgaaaattgataaagaatctactgttaataatatagtacaaagttatactaatgaaatagttgacagctttcagaatacaagtaactgtaataaaatttattctatatttaaaagaaaagactattaatgataattttaatacattaatagtcttttcttttaaatattttataaactaccccatttgtctttattgttttctactaaattaataagtgcatcatcttctttacttgattgattgtttttattaatagaaacttttttaggagttgttttttgttccatattttccgacaatctattttttatttcattaaattcttctggatatttttcattaaaatactctatcagaatatcttttattttatttgatctatttcttttagtggtaatctcatttagaatttctaatatagtcatatctaatacttcatcttcatagaaggcaataacacttctatttagcggctttgatgtcattttctttcaccacttctaacttatcagcatattttatattgctatattctttcaagccttcagctattgtatattgacttctattattttgtactaataatggaattttatatgcttgtttaaatttatctgatagaatagttttaaatgtagtattatttaataatccacctgaaaaaatgaaggtatctactgtaggcatatatttatacatgttattttctatagtaaagaatacatattctgcatattcttctaagcatctatttaatatattttctatttgttgttcttcaccatataagctataattaccgttttctaggatttcttgcaattgactgtaagagtaataagtaatttttttatcttcattttgtctaattaatgcttgttttaagttattataaattcttatgcagccttctccatctagtaatgtatcacttgccataacagtttgcatgttcttaacaagcattaaatctaacgtagaatggcctatatcaacagagaaaatagttttattcatatcatttctaggtaatgtgaatataggactataagcctgtggtaagcaagtaacatcttttatgtaaactttctttttaacttctccaaaattacaaagataactgaattcaaaagaggatccttttaaccaatcttcaaattttttactatctccttttgatctattaggtaatccaacacatagatatagattaaattcagattctttagtaagttgtcctactatagatagtaattcgattaaatgatattcatctttaattctatctctgtttaatctttgcatagtatctggatatctttctatgcatgcatctccacaaataaaatatttaccattatactttattaaagtattttcatcatttaattctttaatagtatctgctatatttaaggcttctttttcagttatattattgatgtaatttttcatttttacttcagtatcatttgtcatacctattccatatccaaaaccagtatcaacaccagcaattatatttttcataaattaatccctcctaaatatgcttgtccatataattttaacataaattataacaaaaaatcaataattatcattattatttaattaaatataaaaaatcaatgataaaacaattataaaacatttaaagtttttttatgttttataattaaaataataatatttttatgattttaaaatatattaaagttatataatgattataaaacataaaaacacaatataaatactttataatgtgttttaataagtaaaaatagatttatatgctttttaatgttaaacataatatattaatcatatttttgattaatttatatattgtgtttaaaaactttaaaaaactgctacatttatcatttataaatgtaacagctttttgttttaagagtttttaaatttttttctaataaagtgaattacataaactattataataattacaatagtacaggatattactttaaatatttttccacctacattactagtttgagatttggctgaatctgtaccagctttattactcttattaataactactggtacaaatgtactattatttttagttgatttttcatattttgaatctcttgtactgctggtgtttggagtagatttattcttattaattgtatcttcatttttagacttagaaaaagaatttgatttaaaattactattcgtatttgatttatttgaattttcttttattgaagaattactgggtgttttaactgagttattagaactaggtttaattttatcattagatttccccttatttcctgaagaaaaggaacttgatttaaaattactatttgtacttttggttgtggaagaattactagatttaggactaattgcagtactggatggtttggatgaacttttagtagaaaaagaacttgatttaaagccactgctcgaattagaccgactagagcttgatttaaagctactagaactacttctactccctgaagaaaaggaacttgaagaaggtttagaagaaaaagagtttgacttaaaactactactatgtgatcctcctttagcataaattgtatttatatttgaaaaaattagagcaaatgtacatatgaagcatactatatatttcattaaattatttttttggttattcatgatagtttgatatttaatatatagtttatatacattaaatatcattttgcacttcctttctttagttatatttaagttaattactgaaactcccaagcctaaaggcatgaggttcttaggtactatataacttctatattatctccgaaagtataatatcactaattattttccctaagactttcactatcaaagattgctaccaatctattaacgatagtataacgcccatttcaagacgttttaataacttatataccaatactacttagattattttttaatccttgtaatctcaatatttctttattgtgctatccatcccacacctaaaggagtgggctttccgcacagttttgtaaaattagtttttatattaaatatttaaaaattattaaaactaaaatgctaaacaatattcctatacaaatagattttatttgaaacatagatagttctcctatgatttatatagattatagtttaattacttttctgagaatagaatatttcagcaatcttatctatttcgcttccatcttcaatttgctcaaactcttctccatgtattgttgtgaagtaatataaaatatacttatcttcactatctaatatgttttctaatagaatatattgcttattgctttctagtaattgtatgattgctaatatcttaaagtttgtatcttctccggtagcgtcattggttaatttgattattttatcatctctaaagatagttatattaaaagtgttatgatcacaattagatatacaagaaccctctttgcagcctaagcaagaattaaatgtgcagtcttttacacagttaaagcaagagcattttaagcattcttctatctgtataaaattttttatatgcttttgtttaaatttttctaattcttctttatatttgctatcgtctttaaagtattcaaataatcctttcccatcagcttttatatttgcttcatcgattaaatctaaatattcttttaatattttagaacttgaataaaattttcttaattttagtttgtcttcttcaagtaaatcttttaaattgtctatgttaaacaatatatcggtatattgtttactgtatttctctttttctttagtagtaaattctataattttattcataaaactcatcctttctatgttatttaattaatagttatagtaatttttatatacaaatttctcaataataattctataggaaaagacactaattaccttattaaaaagctaattagtgtcttttagattttaaaattaaatttattatattctaatctagttttcttttagtctctgaatcagatcaagtatttctagatataaccaaactaaagtaacaagtacaccaaatgctgaataccactccatgtatttaggtgctccataataagctaattcatttatactatctaaatctacaattaaatttaatgcagcaatgactataactaataaactaaagattatacctataataccacctttatataaaggaatttttattccaaaggccaatgataatattaaagaaaatagatttaatattagaattcctacagtagctattatgattccagttacaatttttttatttataggcccaattgatttataaataaccaaagaggatatagccattgctattgttaaaagaaccgctggtaaaacaattcctggataacttaaatctgtgaatttagaagcgattcctaagagtactccttctgttattgcatatatgggagaggttatcggtgatactttaggtctaaaaatggtagtaaatgctaaaactatactaattgtaacacctataattaatataaatctaaggccggcactatcatcaatcattgtttgtgaaagactatctattttattccaagaaaacataaatgaaatagttagtaataacaataatataaaggttttattatatgtgcctttaatagtcattgatttgtcttcatttaaaaatttacttttctttatacctttttctaagaagggatttggtttcttattcattaaaatacctccgtaaagctttattgatgtcaaatttgtgttctaaaaaatccttctaaatagaaggattttttaattaagatttgtatttttctaactcagcatcaagatctacttcattaagtttgtcaaattcatcatctaaacttacaggttttaaatcttctaatcctgctgcagttgtttcttttttgcttatttttctttctatatcatcaagattaatattatctgatgatacattgcatagtatttcatttactttttgactagcttcagcagtatttaacctagcattggcttcatctctatactgcctagtttctgatattgatttttctaagtctgctaatctgcttttcaatttttcagcattttttttagcttcagcatgttttgactctaaatgcttatattgtttctcagcttcaattttcttttctaaagcttttttagctaattcttcatttcctatagataaagctttttttatttttgtttcataatcttccatttgagattttgcatcctgttttttttcttctaaaaaatgcacatttcctaatacttcagcagcagataatttagcattgtgtagatcctcttccatatttcttattttttcctctaatgattctattggattttcagctttatccaatgcattatttgcttttgctttaatcatgttattaatttttgagaaaattcccatgtttatcaattcctttcgtgtatgttttataataatatattatttcttttaaaataatttagtagaattaatatattaataatttatatataccttttttacaataaatttgcacaaataatttataatttcttatattgatctaataattctttattgtaagtatttttatcttttagcattattaatgaactattatttttactgtttttcttcatttgcttctcttttccttcattaattttaattacagaaatataatcatttaatattctataagtttcatttaattcaaagagtaattctttatcaaatgaatcatgactataaattgaacttttatacacatccaataaatcaaaaatatgtttaaacaaaggttctttttctattaacaactcttttagggaaaatataatttcatcaactttatctaagctagatatttttatatattttttgtttttaataattatatttgaaataaattctgctataattcttttattaaagatttcatcaaaggaactccaaaaattaattattatcaaagtattgaaacatgaagatacaaaaagcaatacaaagtttaaccaataataattgccgttagtaatgataagtgcttctttaatagttaagcctaaagaaaacagatgaataatgatgtcgataatatttccaattatctggcatcgttgttctatttttatttctctttttcttaaattttctcttagttcgcaagttatatttaagtctaatatctcatgcattatttgattatattgtgcgatttgataattattgtaattcatattaataccacctttctaaatattttgcttcctcatttattagggtaattatttagggaaattattttatgttgttaggatagcttttttaacattgttataatttatatatacctttattacaataaatttgcataaaaaataacacctatattctagaacttaataatagatgttatcttgaattttagagttttaattattataattgcattaagctaaatatctcaactgttttgtatcatacctataatggccagctatatctgaattaaaaccataagtgaaagtatagctgaacatataaagttcacattaatttgcatacttatcagttataatcttaattttctttgcaatagatttaaaacttttcaataacttattagtaggtttttcatttgctagatctattagtatattaacttgatgattaatttcttgcatatcatgttttgtattgttaggtatagacataatataatcacgctcctaatactatgtagctataactacatagtgcttctattccaataaataatctaaaaatatataagctagtacttcatttctagttaattctttataaacatcaatatcaatttttacatttaaaataaataagatagatttatctttttcaacactgcaattaggaattaaactacgtaattccatagtggaaaaagaactccataatgaagaaagctcaattatataattattagttttatatttatttttttgtttagatatatctctaattttttcaatattatatattaataaatctgtattattaatatatttatttaatatattttcatattctttagtttctttaagaatttgaaatacatctttagctattgtttcagaatctatttgggaaagcaattcttttacagtaatgctttctttatttcttttttttgttttaaatgcagagaataaatttattggtataataactggaagaaaaataatatataatattgctgatagaaataatcgagaaaatgaaggaaacataaaaaaacccctttcttttatatacaataatattaatcataaagtttatttaaacttttaaatattatatatacatcttttattaaaaatattagcaatattattttttataaaaaataaaaagagagtaagctaaaaataatattactcttagttttctctctttcttagatagatttatttaacaagataataaaattatggttaatagaacaattgtcacacaagctaaaatcactacatacttttctgttttgtctgattttattttatcatcaactttttttattaattgctgctccataactgaatctttttctgccataataacaggttcatattctatcattcctactacaacttgtattcttattttacccttacccaagtcacctagttttaatggttcctttacagctttatttaatatcaaacttgaatattctccgtctttaccctttattgctgtagcttcttcaattgatgttatttctctatcaatttttttattactatctactaggattggcattggcataattacatttgtatttgcttttactggtcttatgttagtaaaacataaaagtattaaaaaaaagaaaactcttttacaattagacttagataacatacaatatccctctctttattggtaaatgtaactatagtttattatcaatttttatattttatttgtagaaactcatctttaagatctaatattttcttatcatctatttccgtaggattctttatttcttgtaaaactgttcttccttcaacattttttaatcttgtctttatatcttcacatttagtataaagtttatcaattatataggcttctttttcatctagtttcttacttttcttatagtttactatatcttcctgtaattctataacactatcataatttttagaatcaacttttaaagggctatttaatagtacagttgtacttattatcattagtattatcaatatactcactactaatataattctatcctttgaattcatgaacacatacactccttaatcaattctaaatcatctttaaatgaacctgggaattaatactataagtatagccagtaaagtatgtatacctattataaaaatcacaaaatcaccagtggatattaagtatattaatactcccaaaactaatagtgctacaactataacaatgcaaagttctttagacatataatgcacttcctttatataaattttgtttaataatacattaaaaataaaaactttattcatttattatgctatgaacaacatgcactaccataaaaactaaaatctctatttttcataacttattttatataaaattcagccatatcatcaagtcttatacaagcaactttgccattagctttttcaaatacacaaccacaatcaatatatatagtcccatatcttttaagtattctaacatcatcataattatttgttattgattgtactggagtatgaccacatattactgtataatctctatatttttgttctttacctatattttctctattccataagcaagtatcttcatcttgatattttataaaatcatctatacttaaataattacgattatcaggaaaactcagcccagcatggacaagtataaatttatctatagttttaatataaggtaattttttaaagtaattatataaagatttatcgtatccaatctctttatttactatttgagaatgcgtaatttctccaccattgtaataccataaacttatatcattattttcataaaaatctatatacatttgttcatgattacctttaatcaaagtaatatttttatgcaatattatataatctaatatttccaaaggattttttcctctatctaaaatatcacctaatatatacaatttatcatcatttttaaattctatctgatctaacatcttaatgaatttattatagcaaccatgtaaatcactcataacgtatttactcaatttctcagttccttatgatatcccgtgtacacttacacaaaatacttattattatccttttaagtacagtagattaactgctttttgccattgaatggatttacattctgcaacttttaagtttttttcatttaaaatagttttagatagtttccaattatttttagctacttttaattctttttctgctttagttaattcttttaaaaattcataatataacttactgttcatttttccctccttaaagaaaatactaagatacaaatctttatttcttaatatttaacagcttttccctttgtttctgcacctattaaagcataatatccagacttattagattcataaaatttcattgcaattcctctctttcattttaaatactattgttataatttatatatacttttattacaataaatttgcataaaaaaataacacctatattttagaatttaataatagatgttatcttgaattttagagttttaattactataatctccttaaattaaatatatcaactggtttgcatcatacctataatggccagctatatctgaactaaataccataagtgaaagtatagctgaacatataaagttcatattataactacatagtgtttctattccaataaataatctaagaatatataagccagtacctcatttctagttaattctttataaatatcaatatcaatttttacatttagaatgaatagaatagatttatctttactttcgtaataataaggtagtaaatggcgtaactctatatgagaatagtccgaatccgtaattatatgattattagtgttatacgtattttcttgtttagatatatctttaatattttggatatcatttattaataaatctgcattatttatgaatttatttaatggattttcatatagtttatattttctatcttcttttaatatttttaaaatatctttagctattatttcagaatctatttgggagagcaattcttttaccgtaatactttttttattccttttttttattttaaatccacaaaataaattcatgggtatagtaattgggaaaagaataatattcaatattgcgaatatgaaaaattgaaaaggtgaacaaaacatttttaaggctcctttcaaagataatattatataaattttatatatacatttttatagaaaataaacaatcttaaaactgtatttcctagatatattagcaactttaattttatctttattttaaacttgtatataaacaaaataatttattgaattgatatgtaaatggagtatctattttgatactccattatttgatttgaatatatgatactaactatgaaatagattaattaatcctggcaatgcatttggtataaatattaatattattgctaaaataaataaataaacagatctaatgctaatgctatagcaacaaacacagccaaaattatcataccatatttaagtattttggctgattctatattatcattaatcctctgttctttatcattaactttctgttttaattgctgctccataactgaatctttttctgccataacagcaggttcatcttttatcattcctactgtaacctttattcttacttctccttttcccaaatttcctaatttcaatggctctcttacagatttatttaatactaaatttgagtatcttccatcattgctttttataactgtagcatcttctaatgatgtaatatctctgtcaatttctttactactatccattattggcattggtattggcattggtattggcattggagtagttgcatttgcttttactgttcttatgttagtaaaaaataaaagtattaaaaaaaataaaacccttttacagctagataattttttaaatttaaacatcatatttttatcccctatcttatctgtatcgctaattatttgaattacgtttagaattcttttacccacattctttttgaagcgtaatatattcttctatttttacataacatatggcatctgcttcaatttcacatagtaatcttactttcatttttacacctcgctctaagtcacactatactcaggtcctgcagctgctctttggattacgtctttaccatattataaaaatacaacacacccaaggataataataggtgctataaataaacattctaattaataatttcattcctggaccttatctttgaaatgtgaattaattttttataagttcaaatctatatttttgcttaatgcttgggtatttttctttatctatctcgctaataaacatttcataaggtcttacatagtccataccatcatataaagatttataaacaacatatttcccattaccttcccattacctattgtccagtttttcattggtataaataacttattttcatcattatatagaactcttactctatgtgaagtttcagtttcataaaaaaatcccaattctttaatccctttatatttatgtgcatcaaattcatctactacttctgctacacctatagcgacatacatataattatttaaagtaccactttcatcgtgcttaaaatgcttataaattgctggaaatattaactctcttttcacacttaatttctccttatattagctttacactcatttcaatcctggaactaaatcttcgaattgtgcactagattattttaaaattttttctttttattttagcttcaagctctacatagtaatttgacatttcaaatttatcacatttaaatttaactttatttctacttaagctctcatcatccattccgtaatagtaacattcatcacaattaaaacaactatcttttttaatttctttacattcttcagtacttaaaaatggatagatttcaacactatatttacatttatcgcaacaacatctatcacatatagttgcgtcatatattttatgttttcctataggctttttaatggattctaaaaatgaaagttgttcattcctcaatttatcaccttcaaaatatttagattatgaactaattattgttagtatatttttgtctttatttttatttaaaataaattttagaaattcgtcttttattttacttggtatgcttgggaaaattataaacattcctggaagtactttatatgcttcaatttggtcattataagcttctttaagtgtttcacatatactgtatgtgtgtgacttaacttctccattaaacaaataatattgttgtactaaaaacatatttatcacctctttgtgccatgtgaatttcatttctggaccttatttttgtattacgccttaatcccatttaattttttgaccacatgtaccacaatataaatcttctacaaacatagaacaattagggcaatatgctattttatctgtataaggataattaggtttttggggtatttgctttttacataactttttaatgacattctttttagtaatagatacttcttgccaacaatctattgttcctaatatactttcacaaatacattttaaactcattacgtatcctccaatctttgaattgtaagcttaacaatttgtagttgctatgatataaggttctttagaatatccttgtatttctaaaacttctctaaatgtcattattttttcaactatacttttatcctcaattcctcttcttaaatcacctattccacctttgcattgctcatcattgccactcaattcttctatgtcttttctatcagtagtttcataccacatacaaccattatctaaatcacacttttctaattcaaaatcatcatctaattgataattttttatgacccattctctagtcttctctaattcccaaggacttgcataccactcataattaccatcaaaataaactttcatcctattccctgtatttttgtctactaaagttaatatatctggtcttgctttaatccattcctcggcctgttctttactatcccatttacatattttaaataacccgatagactcttctattgtatgccctactggaattacttctctatcttctgtttcaacatcaattacccatttttgagattctttatcaaatttcactgttgctttcatcattttatattttcctccttctcaattctttcaaactctattacccatacccaaggatttcttttaaaactatatagccaatcatcccatttccctaacgttctatcccatattccagcaaatccagtaatataattaggaacatgttgtgttatatttcccacatattcttgattgttttcactcctggttccatatggctgataccatatttgtttagctgcaccttccgctttagctctttcttctgttatatcttgcagtctttcaacttttacatttgtaacttttaaaaatatccttgctgcagctttaggcatatgaattgatgggtgccaacgttttactccaacatcaataaatgtatgttctttcccatagtcatcacacttatacaaaaattctaaactgtcctcgaactcaacatctgcataattttcaaagtcatctatctttgcccacgtttccctaacataaagaatatctcctattctataaggtggttttgcataatctattattccgccacatttatcttttccccatccaaaacaaccttcttttttagagtttgttgaagaaacaacgaatcctaaaggtattggttgtttaggctgtggtttaataattcttctagtttgtgttttcttaccttccagtattgccttaaccatttctgtattaaaaagtataggtctttccaatttaattcccccttctctacttcacaataatttcaaattacttaatatatttgaattgtgactattctacgattttattttctctatgttcgctccaaagtgggattgcagtttcttcattatctattaaccattgcccctctgaaaacttaacataaccagtgaagctaagattgtcgttatctccaatgagtactgacctttgattaactaagtcaccttcccatatcgggtttccatctatatcattgctatctgtcatttgtcctactgtttctctatctacttctataaattctggattatctacgcttattcttgaatttatatgacatttatagctccctgttgtaatatccatatgcaaatttccataatgccaattccctaatttatctttacctctaaacataatatctctcatatatacccctccaatctttgtatttagagctaactttaacctatatgaaattttttacatgcttttgaaaagttatattcttctcctgtaagtttttcataaagataaggatttttaaatactgcaacctcaggcaataatccttgtgttttatctttagatgtatcccatgcaacacaattccttgctatagtttcttttatttctccaacagttgtgtctcctaagctctcttcataatattttagtttttctctaacctctgcaaaccccacgcacgcccaataaaataaagataataggctatcatcatccatgtattcaccaaattcgcaagggtcactttcttcaatttcaatatcatatagccttttatattcttccttacaaaaatcaactaaactaatgtctgtataatcttcacctatgccacgcaaatacacttctccatctttaccaaagaccatattatgcattgcttctgtattattgttaggattttctgttataatttttttcatttattattcctcctttaaattaagacacattaatttcattaagtatttgaaattgattcatatgctttaccatcatttatataaaaacaatcttgataccaacaataaatttcatatatgcccttttctattcttataacgggtttgtttccatcagtgcatagcaacataccatctaacatagttattgaatttggataaatccttatattctccatagcttctacttctgaatgtttatcattattgatataaataatcagtttgctaccttcttttattaatgggactctacattctaggcaatcatcacacaatatacaaggaaaaccacttgtattaggatagttgccaaaacaatctcttgccatttataattcccccttaattttgttgaacaataatttcaaattgtacactttatttgtattgtgaatcaatttaaaatgatatctccccactgctgtaatataactccttgtaattgtgctgaaatttcttttaacttctcccattgaggtttattaaatttttgaagatattctctatttttattttgttctacaagaaaattctgtagtttcaatacttttgcatattctaatttatttaaagtttttggttgtttagataaatcaaagaatccctcatgtactttatattctttaattattttattagcttccttatctgtcatacaatcctccttgtcgccttaatttcaaattgtacactttctttgaattgtgatattaatctatttttaatattctcgctatttcttccaaattaaccaaacttacttctgcccagtcaatgtttttaacttttgtatataatttctttcttctgacataatcttttatttcttgtgatactggtactaatgcctttgctctcgtccaagaatcttttatacccatttcttttcctttatggctaaaaactgcaccacctatagtaattctacctgttggagaaatcttatcaatttttttaatagcataatctctatatccaaaacctacactttcgactgttacttcatcaccaggctttaaatcttttaaccaatcttttcttttatctctatccatcaaatcaccctttctttgttgcgccttaatttcaaactacaaccgtaattttccaataaaataattttatgccgtattatttgaaatacattttatctactattgttataatttatatatccttttttaacaacaaaatttcatgaaaggcataaaaatatgtgttaattttaaaaattaatttttagttttttgatttatttattaattatatattgtaataataattttcttgatattctttccctttgcctagagcttcgcatatataagcaaaatatcttttttacatatccattattcttaaaatacttaaagaaatttattctttgataatgaattggcttaatttttaatggttcttctttttttatagttttattttgaaaaaataaatttaacatatatcctccttaagtttaaataaaagtattattattttataagctatacattttttataaaaataataggctgctgtatgagatttatatcatacagcagcctattgtttttatatttagaggtatcaaaaaatttggaagatggggttataattccccatcctccaattgttgtaatatggtgtacatatctgctctgtaatcttctccaccaaatatagttataggttcagatatgtggtcatagttgttgcggagaacataatcgaattgctttaggttgccatcatatttaggctattacccaatttattattaatggtttgaaaatcttcaaataacaatgatacatatattttaagatacatctactatagtaaagtctcccactttttcatataatttttcttctatagaatttgatattgaagctgatcctccaacaatgactaagttaccttcatcctctatattagtttcaacaaatttttctgcattagctatttctgttgtacctgcgcctaatccgcttagaactaacggagatcctgttttagctgctgctgctgaagctactaaagcatctgcgaattgaccttgtccagttttcccactttgtcctcctgctgctatatatacattactaaagtctaaaccgcctttacccttaaaatattctaacactgctagattagtttgaaatctgtttttagattgagcatctgaagttatctttttaccagttacagagctaaccacagaagaaggcaacactccgctaccacctaccgcaagaatctgtaatttgttttttgatattatattattttttattacatttggtatattattagtgtttccgaataataccggataaccattagttgctgctactgaagctacagatagtgcatctgcatatccatcttgtccatttactaaaatccctgtttttgatttagaatttaattttaatatttcttctgccactctagcgttagtgccatatcttgttttatcaccatatttctgtccatcataacgtataacttgaaatcccttattctttaatgaattttccatagttgtagatacaactccagtaccgccaactatatatatttttttaacgtcttgtaagtcatttatagtttttaacacatctgattctaatgcgcccttattttcagttagaagtattggagcatttaacaattttgaaagtggtgctgagcttactgcatctgcatagcctgtaccatttactaaaataaccgcttctgatctttggaatatttcctttgctgttttgttagccgtatctattctattctttccattcattctctttatagaagccgcttgtacattagtaaaagaaattcctattaccattactaaagtagcagttataactgaaagaattttcttgtttttctttaacattagctctcctccatttgtataattttctatatttataattatatactatattaattcttatttatacattctttttaaaattacgacctgctttttagcttttgtattacttgattttttacatcatctcctctttgtttatgaagataatatagttcttgtataacttctgatgcacattcttcactacatactttttcaaatgtcattttacctttttcatctataacttttacttggtatatttctttacattcaccatagcattgataacaagcttgttgtccatccctagcttcacattctacataatcaatacattcatttttatctttacaattaggacaattaaagccctttcctttgcatattaagcctttatcctttaggcctttagttatcatactttcctccttatacttccataaatcataattattttagttcttgtagctgttctttgaattacggcatgaaaaacaccgtaaaattcagacttgaataatacggtgttctaataaattattagttatatatgttattattttcttttagcaaatattcaatgctcgtatttttagtaactattgtaaaagtttgaaacggtttttctctaagcattccaatcacagcaatatttaatcctgagagctgtttaagaacttctaacgatatctccaacgctttatatgcatctgtttcatctatatcttctagagaattaaatttactgtttggatacctacactcccaatggatagaatcttttttatcaattaaatcaaaattattatcgccttttggttctagtaaatatatagtatcataacagggaccatgtattagccaattacgtaaattatctagctctttaaactttgattctaatattttatctaatctatttttttcaaacatttgtaagaatagattaatcttatctatcgtttgcattttaaaccatgtatttatgattatacttaaagaaatatttcttttttccactggtatataaaaacttgatttagcgttatcaaaagtttcatatgctattttactaatacacgcttcaatagcacttacagaatgtataatacatgatatacagtaatatctcttcgtgaattgtgtattattcctactacattgataatatagattaaaggcttggcttagatgagttgatattaaatctgatgtcaatgtttgtaattcattttcccttttcatgagatcctccttaatgtattaactcttatttagattaaatgttaatatatttatagtattaacaccgtattattcaattttcaaagaactttattcttaaataaaatttacatcgtttttatttcaaattacacactttttttgtaatatgtcttaactgtttattgtaaaatctattttccccgtaccgtccatttcaattttacctgtaactatttcttcattatcttttctttttggaaagatactatttgttatttttactatttccaatattgcttttgtgttatcataatcagcttgagttaataagtttgccccacatttagggcatgatttatttagccatttatcataatcctctacttgcacattatcatctctaaagtcacattctggattatcacatttaataccttttatatttaattcaatcgcatctttcatttacacatctctccttcaaaattttgattcgcattgatttgtctttatttcatattatgttttttaaaatgcattatttttttatctggtattgttataatttatatatactttttttacaataatattgcaaaaaaataatacctataatttatataggtatcatttttgcatatataaagatctattgaatagtagatacatcttttataataatatttgcggtgccatctccattatctctaacttcaaaactatttatatcactatatacatcttctggaatactcaaagtaatatttttattaagcttaaatttaagtgtatctactattttagttacaaactctttatctacttctataggtttgtctatattgttttcataattgaaattaataaattcttgttttagtgtttcatctttaaatatttcatctgttatatcttcaatatttattgtatcctctttttttagtttttctcttaataaatctttagttttcacagcggtttttacatcatctatgttatcttttataaatttatctgtattttctactaattgccttgtcatatctctttcattttctattacattgcaacctaagtaattttttataaaataattagatccatattcttcactatctttggactttttttgtttgtctataagcattaagttaaattcttgtccttctctaataggttttataaaagcgcatttttttatcttagaagcggtcattggtaggcctgtaacctcaggtgctatgtttataccaatcttatcctcaacagtatctataacatgtatataattctttatataatccatttttaatatcccgagcatcggaccatattctgtagatatagaaactatcattaagtcacaagactctatattatcattaccttccattaatacaaaaagctgcttggccagttctttagatatagttagtaaatcattttgaccattcaaatattcttgggaaacttcttttgctatatttctttcattattaaatttggcatatcttaattgttgatcctttaaacatttctcaacatgctttaatataaatttataattttcatcatctaatcttagcttatattcatttaatattggaccattagcattgctatccaaaatatgaataattgcctcattaatatttacttcttttatatattccatgtgttaacaactccttatcatatatagtctatatagctgtatgttaataatgataatcttggtcttgtatttttataaataaatatcctttttaatacttattactaattacatttggctattgtagaatttgctatagaaattacttgttgtgttatttcttcattagattttctattagccttataaattttagattttttttcttttaatccgttggcagatatagcaacttcaacatctgatgtttctggtattcttttagctttaatattatatattttattactagtgttaactgtatatgaggtgttataattccaatatttattatttatttctagcataataagtgtagaaccaataaaaagagcagcaattaaaattattccaaataaaaaattaaatctatcttttaaagtcatatacatacaataaacctcctatttatgcttatatatattgtatttaagaatgcttttatattcattttgtaatttgtctatttatgattatggtaattacaaatttcaccatttaataaaccttcttaaatggtctagttacttgtactatttctaattttaagtgcttctttatatcgtattgtttcacctaattttctacttttactagctaacttttcgacttcactatccatcttaatggacttataaggcatagtaaaaatctgtgatattagtgaagtatacttaatcctttctaaatcgttggatagagatagtgatttcttgtatattctatcactttcttttaaatatttagtttctaagcttgagtcacttatatataacaattgagcatctctgataataattaataatccttctgatttattaatatttgctttgtatatagaaattagcgatactagcgataatatggaaattaatataattggtataatatacttaataaccttgttcactacaataggcctccttacgctactcatatttatttctcttaatctatttgaattatgacatgaaatttcttaaacttttttcttcttcatcccaatcaagctgatctataatagccatgtcctcaccacagccacattcactatgccaagtaatttcagttccacacctcaaacatattgaaggttctaattcaggaacttcataatcaggcatatttcttaatccattttcccatagtttgtcaaagaatttttttacttctccatcactcatcaaaagagtaaaatttgcaaaatctaatccttttttcttaattataaaattcaccctctcttttctgtttgcaggcttcttcaaatatattcacctctttatgtcgtcttaatttcatgatttccacctggtatttgtaataagttttatttatataccaaaaattttcgaaatatctaaaatgtttccagtttcctgattaatcatatatgagtttccacattctttacaatgccaatgtagatattgattatcctctctttcacactctccattacatttagaacattttagattagttattacttttcttttaaattcaataaccttacccatgcatataatttctcctttgagattatttcgtataaaattcagctcctgcagttgttatttgtattgcgaattattcttctaactttcttccacatataggacaataattaattttaatttcatctaattctaaatcatcactaccaactaatgtattattaccactaatatatatatcgtcattaaaactatccgttaataatgctcttctgttgtctacatctccataacaatattcacattctcccactttactcactccctcggaataatttcaattcttgtaactgctatttggattatgtcttaaaatctccacgtttttcttttaatattttaatgcattttaatactgctttaataggtgtctcatatccgcttgctagaatagtttctccattaattgtagctattccgcaccatcctacatcctctctcatttccatagcaaattctatattaaaatattgaacacctatatcataatccttaaattgtattaataattctgataacatagacaattcttctttaattttatatccctcctatttttgtattgtgtagctaatttttgcaataatttcagctcctacagctactttttggattgagtattgaaaaattatttcaaatctattttttctatattttcaattttaaagaaatctggcctatagccatatttatccatccatgcaaataaaacttcattgatctgtttttctaattctctttggtgttctgtatctacatccatcaaataattttcacctgcttccataccatctgctgtattttctgcaacattttctaatataaagtccacatcaacaccacatggggatacttctactatttgacctatattaaaataatcattacaaaaagcttgttcttgattttctaatgcttcttttctgccagcttcgatggcttgttcctttgtattaaattcctctcctatccatatttcactatctattaatgaatacatccatttaccttcaatattattatcagtaatatcaacaggttttgaaattgttggctgtctatctataatatttttcaaacaaatcattaaattagcttgttgcatgaactccaaatcgttttgttttatttcttgaaaaagtttatcagcatctataactctcatttttttattaccttctttctttataataatttcattcctggatataatctttggactgtgagctaatatttcacaatctcaaatctatatttttgcttaacctcaggatattttttatggtctacctcgcttgtaaacatatctacaggtcttgcatatggaaatcttgaacactcgtataatgatttatatattactaaattaactttactatctttaggattatggtaatattggccttctttttcaaatagcgttattgtacactcatcttctgttaacttagcagtaattatattcactccaactgttttaaataaagaattaagtacagaatcataatctcttaatgacttacttacgaacatagttacatacatataattattaggtattccattatcagagtgtttgaaatgtttgtatattgctggacaaattatacttctatgatttattgcttctgctaatgctctatttcttaaatttatttcttccaatgtttcagttttagatatgttcatttatttcatcctttcttcgccattattccatttctggaccttatatttgaattgtgacattaattatattaaacatgtttaaatgattaatagtactttctaatctattgctggctagataaattattgtatttttttatggttatagattttcctaaaatgaaagcaactcctaatttacttagccaaaaataacaatttttattttcactattaaaatctttttcagctaaatctttagcaactaaatcattccattttttatcgcttgtactagaataaaatctatttctatagggcttttttccatagctaagtcctaaagcatgtttcatttcatccagttgttcttcagtaacttcaatttgttttttaactacttttaagtatttatctaattctttttgtgttacatagtaagtacctaatagttttttaccgcttgttacaagtattccatttcttatatcagttctaagtcttgatattcttatattttcattaaattctatatcttttaatgtatataatttctctcctaatattgtaattggcatacatttagttaatcctaataacttatttaatctctctttttcaattaatacttttatatttttattaaaagtgtcttctctttcatagatttctgatattcctaagagatctagaggtataggaatataatcactatttttatattttgttatttcttcttctgtaaatctacgagctaatcttaaatctgagctatatccgtttttacactctttattgcccaaaaatacagcccattcttctccatatacatgattatgccaattgtatgataatagatataatactttttcattagaattttcatatgctttttgtgttaactccttaatatccatcttttctatctcccttatcttttattagtgaatttttaaaatttaaatgtttgcttaatgttataatcttttctctacatttttacaatataaagaaaatcaaattctgtctgaaatttctccccaatagttgaatttttgtttgtaactacagccttttaaattaaaatcttcttctccaatttcaatgtgccttatttttttattactgcatttttttaagtatttatcattaatataatgccgatcccaataattgatttttccactttcaaaatcaattccatacacccaactaggcatatatctttttatttttcttagatgattgagttttctatagtacatttttttttggaatctatttaatttgaatttagacttgttattattgagtatatctttatatatataatcatagccaagcaattccaagatatctttaatttctcttatgttattagaacagttttttagaaagccttctatagtatctaagtcttctttatctaaatcatatttttttattattgttaaaatttctctagagttcataaaaacacatcctttgcatatctcctgtataatatttcattacatgttaaatcctttttcatatatacatatttttttattttaaaaacaaaaaacaggaaaattaatttcattttcccgtgttcttatattttacagttataaggttaattttttagagacctgaacctctcacgactaaagtcgcaaggttcttaggtactatccaaatttcttttggataaccgacaaatgctaaagcattgtcggttgacaccaatcactggttcggtttccctaagactttatcgagcaagatttccattgaaatcattaacaccctacggggtttatcatatcggctcggttcaaaaccgtatgcccctaagtttaagtagtttaggttatagacctatgctacttaattgttttttatttaagcttttaattctttctatttctttattatgcaacttgaagaaattttcaaaagttacatttgctctatctatatctacctcttttaagttatcctttgtattcattatcagaaatgcagaatacatatctctttgaatatttccttgctcaaatttgttccaacgttttgataatggctttttaacataagtttttgtaaaatgttcaaattgacttgctttaacttcataggtatctatttctttaattgaaaaaccttgatattgaagttttctatctataatagttataagcataccaggtgctttattaccaagcgatttaccaaatcttttcttatgattaatctttccagttttctcatttacagtagtttcttttgatcttttttgaagccctttaaaattcatagtttcaactctaacatcaagaccaagagaaagaatgtaatcagcaagtttattatgagattgttttctcttatctgcaattttcctttgaatttcacgaagtgctaactttgttttaatataacctttactttgaatccatttgtcatgatttccttttttgattgtgccatctttgttatatttattagggttgtttgctctacgttgtctatcaagtttcctttgaagaactcttttaattctttcgtcaatgttgacatcttctgcaagttctaatattttaacttctttttcacttgcgatagcaagagtagaagtaccaatatctaaacctacacgagaattttcatcagtagaaaccttacggttgttcttttgtgggggaacaccctcgaaagtaatttgaacaaaatatctatttttaccacggataacttttttaacaagtttacaaaactttaatttatctaaaaaacattgatttgcatactcgtcatttctctttataattactggtattgttagaccaagccattccattacgtttctatcttcaaaatatctaaaacctgtgatatttcctttttcacgtacagaatggaactcgccataggctttaaatctaacttttttagcttctttaaacattaatttttcaaaagcactaaaagaacgttctgcgatttcttgaaccatttgagagcctaagttctttttaaacttttgccccataggttttacaaatttatttaggtcaaacttagttacaccaaagtcttttctaagtttattgaatattgcattacgttttttacccttttccattttcattgcaagaccatattgtttttgtctttgcattactctatatcttgaaagaatttctccaagacaagcattgtagatttgacgagcaatatttaatcttttttctaatatatcttcttgccacttttccgttttcagtggaagtgtcaaaacgtagtttgccactagagaaattcctcctttgttttttcattttttctgttgagtttcaatgcattttcttatttgttcttctgtatttttacttacagtcaatgcgaagtagcttgggctccacatatgcccaccccatagcctattttttagttcggggtgcaactgaaacattcttcttgcagatataccttttaatgattatagaatattaggtatatagtgttgtggagtacactctattagcaaatgtatatgatatttgtcagtttccatttctaaaatggttattccattatcatttgtaagttgatttattatattatttaagtctttttctacatatatattgttataatttttatatgctttttttacaatatatttgcataaaaaatagaataagtattaaacttatcctatttgacctatatattaaattgttttcatagttttacattcttgttttacttttttcttagttgctttcatgattcctttacttataatttctgacataatgtatacttcatatagtctagtattttgaagcattataaattctataccattaccagataagttcactattcctgtaatacttatatctccaacagaaggcaaatttttattaagagccgaacctggtgttagtggtttattcttaatttctatattacctatgttattttcattgcctaaacaagcgtctatagcaattaaatatggatttttatatttagaatttattatagaaatagtttcttttaaatttttagcatggaccgggtttttcaaagtaccatatacaggatagcagcaatttgctttagttaagaatgttcccactaatggtcctaatgaatctcccgtagatctatctgttccaatacatataaatactatattttcttcatatttaatatactctaatatttcattgctcaattttataatattatattttttgctattagaatgtggtattatcataaaattttcccccttagtttttagtaatgttaaccataattaattgattaataaattattattccttttctagcaaatagtctatgtttattagccaagatatagatggattttatattttgctcgtatggttcttgaaatttactttgcataaacaattgttaactattcaaagtcttacacctactttaaatttattgttataataattgttttgtatggtatttacatatactttgaaaatcttttttatttttataaaagtaataataattatgtgacaatattaaagtagttttaaaagtataaataacagtattgtgtaaaatagaaagaggtgtatgaaatgataggatctattataggagatatagttggttcttcatatgaattaataaatacaaataaaaaagattttaatttatatagaaaaattagcagatttactgatgatacagtattgacaattgccaccgctgattgcttattaagagaaggaagctttaaagacttttataggacacatactcttaaatatcctttacgtggatatggaagtaagttcttggcatgggcttattttaataagaaaaatcctaattatagtcttggaaatggtggggctatgagagtatcccctatagcttatatttctaatgatttatatactgttttagaaataacagagaaaagctgtatagcaacacataatcatcctgaaggtattaaaggtgctgaggcaatagcagcatgtatttatctggcaagacaagattgttctaaagaagaaataaaacaatatatagaaaatgaatataagtataatttaaatatatctgttgaagaattccattctaagtataggtccaatgctacttgccaaaatagtattcctcaagcgatagttgcttttttggaatctacagattttgagagctgcttaagaaatgccatctatattggtggagacagtgatacagttgcatgcatggcatgtggaatagcggaagcctattataaagaaattccttatggtatatttgaattttgttttagaaaattaaataataatcaaaaatctataattaaagatttttacaataaatatattgtcagttccactataacaaataaaattaatgatttagtgtaaatatctactgtattacaaatgatatgagatttttacttgaaaacaaaaaatattaaagataaaggatataaaaatggttataaattgtataaattaaaatttattttttattgtataaatggataaaaagattattatatagatataactcctttaattttatagtttaaagccataaactataaagtagcaagacttatatagtcttgctattttttggtaaatctttatttctttattgcaaatttcattatattatttatatctacaatataattagaaggatctatttaatattgatttattatatgatctaaatctttttcacagatagtttctttttccattaataactcagctattgattttaaagtatctatattattttttaatagattatatgtttcctcatatatgcttttagataatttacgagcttcatctagtattatattattatctacatctaattgatataaattaagcataccaaattcatcatccataccatattgtacaatcatttgttttataatttcagtagcttgttgaatatcggcactagctccggtagtaactttattcttatcacccaataataagagttctcctattctaccaccataggctagcttgactttattcttaagttcttgtattgagtataaagacatctttttaggaacaatcatggtcaccccaccagctccactagttgatggtgtaattgttactttaggaatatccattcctgtaagtttgcctattaatgcatgaccggcctcgtgccaagctactaatctaatatcatctttatctcttttttcatcttctttagcatggccttttaatagaattttgtacatggctttatctatacattctgtatcaatattatctttattatattgaatagagattagaacagcttcattaattaatgattctatttgagctggagaaaatccaatagtttgtttagctaaatttgtaaaatccacttctttattaaaacacttatttttactataaataccgattatttctagcctttcttctggtgttgatggcaaagatacacttatatgtttatcaaatctaccaggtcgtaataaggcttgatccaaatcttctattctattagtagcggcaataactaagacaccttctgatccattaaatccatccatttctgctaatagagcattaagtgtttgtctatattcgctattatcaagatcaacatctctttttctaccgatagcatcaatttcatctataaatataatgcaaggagcattttcacgtgcttcttcaaataagctccttactctcatggctcccattcctgcaaacatttcaataaaatctgaaccattaatagaaaagaaaggtacatttgcttctcctgctaaagctttagctaataatgtttttccggtgccaggttccccgtataggatagctcccttaggtaactttgctcctttatgtgtgaatttttcaggatcttttaaaaattctactaataaatgcatatctttttttacttgtttcaatccagctatatccttaaaagatattccatttttagaagtatctgaatcaattcttttattctttatttcacttttattatatatagatttaatttgagatatcataaggatcccaaataaaatgaagataatctcttttaaactttgtattaaattttgtttatgcatctcatttatttcaatattatattgaagcaattcttttttaaaatcatttgtttttggattatctgttatatatttattatttttattatttatgaatacaaaattatcatccttgaaatcaatgtgtattttttttatttcattatttttcatttgttttataaagacattataagaggtctttgtagcatttagattcacagcatatgattttagtgttggtattaatatactaataacaattaaaatacctattacatatttatttatatttatttttattttcattcctcaacaacctttcctctcatagctttgcattaaaataatcagatatttatcattgaatatccgattattttaatgtacttataagcttacttttttaagcctttttgaatatttatatatttagttcttctccttttttgtatttcaattaaattttttttgtactctttatctgttgttaaagctatagcacacttaagtaaataattattagaaggaacttttttatcttttattatatttataagtttattacatgtaagatactctttattagctttcttactttttatatttataaatgctttattagtaatgtatccgtttagatccacatcaccatttaggttaattattaaaaaatgttttttgtttcttattattttaaaattctccataattactcctccgtataaataatctagatatttttatatatacatatttaaaaataataaaacactttttaatttcatattgtataaattcaattttcgattattatataagtatgaggttaataaataacctaaatcatccatccttatattttagtttaaagccaaacaaaggaagcagatagttaattatctgcttcctttatttattatctactgacttttaaggctttaataataagccactatttatgatataagtatgttggtcattaaaagcaatatgttttaaggttacttttcatattttttacaataaattatttccatatcattttctggtctattaaaattcgctttaaattcagaaattgttatatacattttggtatcattgctttttataaaagtatctagttttttatttattttattatctgtttgtaattttattatattatgcagctgcgcaatattaatattagtttcattaatagagtcattatttagagatttaacattaaaattttgtttgtttttcattaccataatagcggtatctatttttatgctatttttatttaataattctaatgccatattagtttgattatttttaaataaatcaatgctgctttctattatatgttcttttttatttttttcgtaattgtaagtttcagcattcagtatattaatattgctaataaccataaaaactattaaaaagcatccaaatagcagaaaacttaagccagaacctttattattttttaaacacataatttcatcaccactattctataaatttcatagaagttatttctattttatgttctgctgattcattagatattatatttactaatctttgagtaacagcagtatttttttgatttaatgttgcttttattgtagtaccaggtgttaatttttcattatatatttcagtactatctatttctcggattaaatttttatctttatcatatatttcatatttataattatagtctcctataaaattaagatatcttttcatttctttattaaaaaactcgtgagtactatttctaagctctttattatagcttatatcttttaattcttgatacattaaattatttagattatttctacaatgcatttccatttcacaataatacatatacataaaagcaaatgtacatatggttaatactatagtactagataatataacagataagccaccttttttattctttaatattttcatatacattacactttcctttctataataagttttatattttttatatatacatttttatagtaaaaaagcacctatttaaattatttaaataggtgcttttaatggctaaatttacctgaattatttaattacacttggttgaaattcatccataatttgtgtctgttcctttacgatattgttatttgaatcatctccaacttttcgtacagactggccgttcggatgtatagcacttataaagataaataccgtaattataagtaataatacaacagatagtaattgtgatagaccaccttttttgttctttctaatttctttgattttattcatcataatttgttacctccaaaaatttgttatagattaatttatttaaactgaataatcttcagttttttattgaattaatatttaatttatggtagatctggaaggtcaggtattgttggtaatcctaaatcatttatttgttgttgttcattttcaattgctgctacagagtctttaccaacattatcaattgaacgaccattcggatgtatagcacttataaagataaatactgtaattataagtagcaatacaacggataatagttgtgataagccaccttttttgttctttaaagaatttttgaatttttttaacattaatattacctccgcgaaatttaatcaaaatattttaagaaatcatattcaagtaggtacatttatttattattacttcttataggaatcgtacctttttagcaaaaatattttaaaaaattatatttaagtaggtacacttatttattattacttcttataggaatcgtacctttttagcaaaaatattttaaaaaattatatttaagtaggtacacttatttattattacttcttataggaatcgtacctttttagcaaaaatattttaaaaaattatatttaagtaggtacacttatttattattacttctcataagaatcgtacctttttagtaaaaatattttaaaaagttatattttaagtaggcacatttatttattattacttcttataggaatcgtacctttttagtaaaaaaaataatcatcttaactttaattattaaagttaagatgattatttcaattattgtttttatctattgatactgttctattgttattgattttaattaatttatttgtatttctagataaaacaataaagttacctaacaaataagttgttattaagagtattaacactacagacaactgatgtgataatcctcctcttttattatttagtatcttcatattatcatctccgtattatattaaaatttcatattttgaacttggtttacactagatacagcaaaattaacaattagcatcattaataatactgttcctatagtaaataataatagaattaatccttctttattttctattttattttgatattctaattttcttattttatctatattttcattgtatttttttatgttatttaaggctaattctttattactatcttctatttgtcttaataaagttattattttatttatagcttgtttatctttatctaacataaataaattataagcttcatctctattcatataatacgccatttgaaatttttcaagtaatggttttaaatatttagcgttattagtcaatattgtcattaaaccttgagctgtaatattaagattagagcctattacagctaataaattaattaaatataattcttccttttttatttcttcttttcggatattagctattgtgaatagaataatatcagggatgaagaaactagatattacaataattaaatacaatagtaatctttttaatgaatacaaatggtttatcttagctaaatcatttattactactgcagatatttttggtgcatcttgaggggatataccaccttgttttattaatataacttgtattttagcatctgcactatttttatcatcaatattttttatatatttagttactaattttatattttctttccttactgtaggattattatatatactagttttagcatattcgggatatataacgttgttataaattttttcttgagacaatatagtattagttgaaaatattaatattgcaaacatagatacaactataattgttacaatttttagtgaatagaaacttattaagtcaatgtttagtagtgatttttgtaataattttatatctttcaaatattcttttgtattttttttaggagcaatttttattgcgcattttcctatgattgttttctttaataaaaaacgtccttgttttatcattgaataatagtaccctaaaattagtaaagcaaatgaaattgcaattaaaataataatcttatacatttattttatcccctcctctttataatctttctaataaatctattacaaaatataataatataaaatataaagctataaatgtaaacttactagtggaaatagatattcctgtttgttgcaatagttcagcagggaataattttaataataggtttttagatacaaaagaacatatgatcattacaatactggctaatttaaatttaaatagtctttcagttatccttttataaaacatattttcactttgcattgtagtatttatgtctgtaatttgtatattaagttgttctatattgccaccaaactctagataactttccaatatttctgttaattgatttacatatatgtttttaaaagtatctttgaatgtggaaaaagcttttttgctatcatcactatttaaatataatgatagtgttaaaaaaggtttttttattgtatctgttaagttttcagatgttttatttatagtttctactacattattagttctaaataaccaatattgtaattcagtaaaagcatcatttagtgactttattacttttctatatttgttttccatgatattttttgtaattacaattggaatagctgaagataaaataatgtttaataggcttgtataccatatatcattaataaaaaaacttaatattatattaataatagaattaaataagattaattctattattaaataagatactgttttagatttatttatatctattgtaaataaatttaatctattttctatacgcctttgaattttagataaaattatagatctatcaatatctttaataaagaaaaatttttttatatttattttatctagcatttgcaagcatataaaaatacttacagatgtcagtatactagtgtagatcattaaattgttattcatatataaaacaccatctctttcttttaagagaatatatcatctattatttttttattgttttcatcaaattcaaattcaaatgctctttcaaaaaaaccatctgatattttatttacttttttaaattctttattttttttatcatatttaaatattgtatttaatccataaggtttttctttattggatttatcaaatataacttctgtgatagattttatatatctttgtcctgtttttctatttataccaagcattattaaaaaatctacagctcttgatatatcatataaagcacttaattcattagtatatgtcccattttgcattagaagatttttatagtcatatataaagtcttctggagaaactgtatgaaatgttcccatactacctttattttgtctggtcatactatttaaggttattactgcttcctgtggacttctaacttcacctgtaataattatgtctctattcaatcttaagcatgtttggaaagcatcatctggaattttatatgataagaactgtaattttttaatatctttttgaggataatatctatcgggatttaattcaaacataggctctaaagttgctatagaaatattgtctggtatagatcccattaatcttagtacataagttgttttacctgtaccttggtcccctaatacaaatatatttggtctacctggcattatattatctaatgttgtttcaatgtcttcattactagttttaaaatcaattaattggtgtttagttattaacgtagcggaaaaatatcttatatttaaagaataattatgtgaataaggtggacataaggcagtaactctttcaccatttaatctttgacatagtacctcaggattatcaggttttaaatcaagttttggtttaaaagaaatactttttttaacgacctcttgatacattttttcatctttaaactttaatttaggaattcttttccttacaccacttatttgcaatgatatataatcataactattggtgcttatttcatttaaacccgttatgtttccatctgcaaaatcatcaattactgacaatccatatacttcttgatatactatttgtgtcaatttatcttttctaatttgtatattgtcattttcattaataataaatttattaaatattgatataaataatttatttgaaccaacatatataggttcgaaataatttacatgatattcttttattaatttatttatatcctcatcatctacattttctgatatatatttattaataattgctttaatagaatttttacatgtaatatcacctgcaattgctttggtcagtatagttttatttaagttaatctcatttattgatgcggatttgatgaaattttcctttatttcttttaataactgatctaaagtcatagtacgctttcctttccaatttttttagttttatttagaatatgttacatttgtttttctggcatttttatctgagtattttaagaataatagattaccttctcttcgagcttgttctatagattggatttcttctaagcttgcttttacaacaagtaatgatggagttttttgaccttctgattccccactgccaatatgttttactatattccctgatgtatcggctatatattctacttttaatttcgcagcaacaacatcagtagattttacttgtttagttttagcattattatttttagggtatacaaccataacatcaatgaaatcattactatttatacttaaatcacttaaattttctagctttattggaattgaatatggtcttaatgtgttattttgattttcttttagagttacatcatatttttttatttgctcattaggttctaatttatttactgttatcttacctattaaatctttttttacgtttatggtatttttggctatattatttattggcattattttttcttcaatatcaccttcattaattagctcaccttcactgattactcttttagcgattattacaggtgcttttgaactcttgtttaaagttggtaaattaatatttgcatattcacttacatagtacgctcctgcaatagccattagccaaacactacttgtaactaatatggtgcttattattttattcctggtattattactcatttttttactcataatatatttacctccgttcttttcatatttaattattattactttttttatatatacgtttgtattaaaatttattttttattgtataaatagttaaaaagattattattatagatataaactcctttaattttttagtttaaagccataaactataaaaaatgtagcaagaacataaatatgttcttgctacattttcattatgcttcaggagatggaattgtttcacctaaatccttaagttgtttctgaaatttcaatatttcttttattatattttctttatttttagtggtaaagtctagttgatttgctttagatataagttcagccatttctttttcaccagctaatatattgttcttttcagcattttctttatatttagctaatgtctccattacctccatataacttttagctttgtccattctgttcttatattgactattattatctaatctatttattgctttttcagcatctttatataggtcctttactacatttaagttattcattatatcagcgtagtttatatatctgtctaacttttccactgcatctcttgcttgtattgctaaatctatctgtgatactttattagttgtgtctagtcgcttttgcaattctatttttatatctgaactttctaatttatctatagctgcttgtgcttcttctattgctttaggatcttttgttgctatagcttttcttattaagctttctatatttcttacttgattacgttcttcttgtttattttggttttcttttcgatctatatatggctttaaagcatctaatactctctgcaattgagctttttcatttttatatatagttgtatttagatcatgaactgctttttttgcatattcataatcttctttatctaaagttgtctttacttttttaacagcattataagctttaatataagcatccttttctgctttgatttgttttcccaaatcatctaatctactagttaaatcatcctttaccttaccatcttctaattttgatactttattctcagcatcttttatgtcttcatcctttttagttttttcagctttttctactgcatctttggcctctttttcttcttttagcttttgttcttgatcctttttcttatttatcttgtcttgtacttcatctaacctattgctgaaatcatctttttctttaccatttggtaatttatttaccttttctctagctttatctacatcatcttgattttggctattttcagctttttccactgcatctttagcctctttttcttctttagacttttgctcttgatcttttttctcgtttatcttattttgtatttcatctaatctgtcattcaaattatctttttctttaccatctggcaatttatttactttctccctagctttatctacgtcatcttgattttggctattttcagctttttctactgcttttgttgcatcttctaagtttttcttaccttcatcttctacattaacgtttatttctgaagatgaactattttggtcattcatattgcctgcattatctatagccttaacttttatcttatgatcacctggagataaggttacttctccagcatatcttataaattcaccatcatctattttgtagagaatttcttttataccacttaaattatcagtagcagcaatagtaagtttatttcctgttacatttatactattgattacaggtaattcttgatctatcttatttactattatttccttactagttttattaccaacttcatcttctattattattttatatgttccattaacagcttcagataatttaatatttatttccttattattttcaccagttatttcataatatacataatcataaaatccatttttagtataagtacctgcagttatttctgaccaattattaatattaataacatcattatctatagttactttactaatttttttattatgagtagcctttatatttatagtttgtttttctttagtccatttacttaaatcagttaacacttttattattggagtttctttatcttttatagtaactttaaattcagatacgtcactttcattaccggccttatctatagatttagcataaatagtattttccccagcgattaaattgtctaagttaaaatctttgagatctatccagttaccattatttattttatataaagtttgttttacacctgattcattgtctttaccttcagttattttaatactatcttctattctagttatagaaggtttagtaggagctactttatctatattacttacttttaattctttagtcttagtattaccagcttcatcttccgctacaaagctataagtaccattttcttttatagtaaaagttcctgtatctccatttatgacagttccatctggtagctttattgacttaacttttgtgttatctgttgctgttacttttactgtaaaatctttgttggtccaatctgatggtattcctgttaggtctatttctggtgcttctttatctttagactcagtatcatcaaaagtaaaatcattactttcctgatattgtttagctaaatcttctcctatatgaactttattataaaaattaccttgataattatgagtaactccatcattcataacaattaatattttatcgctacctgtactattagagaagaatcccgctatttcattataatcaatacctttacttttcaaatcacctatgttagatatatctcctaaagattttgttgttaaatccttcattagtacaaatgtgttattttcatcaactttaactaacgtcttaacctcgttaccatctatatcttttaaataattggtattaccagaaccatctaatctaaaaatactaccatttttaagccacattacatcatttatagatttttgatataaaaatgccattgtattagtagattttaatgcagtaccttgcatagaataaataacattatcatctaatttaacaaatctattagataatacttctacaacagttttattactaggtatagaaacattgcctgttaaagtttttaaagtaccatctttcattaagaaataatctggtcttgcattagtagatggaataattgttttaacatcattcatatttatttgagtagattttaaagaactatctttatctatataaaccaaattaccatctgttttttcaaataagtaatgtgtggaattattatttttatcatgataaactaaagtatcttttatttcattttgtttgatgtttagagatatctcattattatctttaggattaatatatcccacatcaccattagtatgatatacaaaaggtactactcctatattttgaacataccctaattctattttagatactgagttgccatcaattaaaacaatatcagggttagtagaattaaaatctttataccagttaaccataccgtaattatctatagtaataatccagccattaggtaaaacatatttagctttagttttatctttgtcaactaccaagtttgatacttttaaagtattattagaaaaattaacataagaatttatgagattatctttaccataataccctgtactccatgaaccatatttttgcatatcatttagattgtaaattttatctactatttctttggtattgtgtgcatagattggtgttacataagttggtgtattttttatattagtaatcctccataaagttccatcattttttagaaatcttaatcgttcagaggaaaagttcaagctacaaaaaactttttgtacattattaattggaacttcaaataattcagaagaagttctaatcaatacagtcccatcattttttaaaattacaactgaataattatctatacgttttatatctttaacattgcttatttcatttaatatttcatcaccatttttttgtttactaattaataaagttccatcatttttcaaaaaacagtataaataagttgaacaagtttctattttctttatattattcatacgttttgtctgagttaccaatacactatcatcattttcaataaagcaaatattttgaatatagtcaatatcacctccaaatttttttatattgcttatatttgcttttttagttggtatatttacataattgttattgttaagtcctgcaaaccatacagtaccatcatttttcaaaaaataagttctatatctatcagatttcatttcttttacatcatttattaatacttctgttggcgtattctttttattcccagatccaatacctaactgctgaaattcgttacttccgcaacaccaaacagtgttatcattttttataaagaatgtcgctgcaccatctgattctgcaagtactatttctttgacattatctatatctacctttgttggaacaatttgatttccgtagttcccaacacctaattgaccgtaataattcctaccacaagtccatactgttccatcattttttaaaaatacagtatactcacttttggcatatactttttttacatttgttatttgtacttttgtaaagtcggtaatagtttcttttgtacttccgacacctaattgtccattattattagagcctgatgcccatactgttccgtcattcttaattagaaattctgtactgctacctcctatttcaatatcttttataccaccataagcaataatattattttcagtattagtgtcagcagcaaaagctttattatctcttacaatgcttatactattgtcctgaaaatctatacttataggcatggctaatattgttccaaaagcagttactcctacaagtgcttgtgctattttcttgtttattatttttttatcatatggcttcatatattatcatacctccgaaatatttaattaaatttttattattacaattaattattatttagtattttaaaaaccgtactacattctaatcaatttctaaaagatattgatatttagtttatatacaaaaccttataaaataaaaacattttatatctatatatttatatatacttatctttttgttagggtttaaaatttgtaccctattgaaagcataaaaataggcaataagaattgatcttattgcctatgaatcatatctagttttgcgaatgtttgattttctccacaccatgaaagtttcattgtaccagttggtccattcctttgctttcccactatacattcagcgattcctttatcttctgtttcaggattgtagtattcatctctatatatgaacattattatatctgcatcttgttctatactccctgaatctcttaaatcagatagaactggtcttttatctgctctagtttctggtgcacgtgataattggcttaagcatattataggtacatccaactctttagataaacctttaagacagttacttatataacctttttcttcattttggctattaaatttcttagtaaccataattaattgcaaataatctataattattaaatctaatttattttgcatttttaatcttttacaatcagatataatggtatttaaagatttagatttatcaaatatatgcatattatctcttttagaatatataatattcatcgtgttagatatgttaatccattttttattatccatttcaggatttatttcatttaaagatatccttgccatagaacaaagtattcttgttactaattgctctttagacatctccaaactaaatatacctacatttttattttttgtgaatattaattctttagctatatttaaaactaatgcagtttttcccatagaaggtctagctgctattatcattaagtcttgtttatataatccttggatataatctttcaataaatctattactattgctacattaggaccattacctgcatatctattacttaaatcattagttatattatctaatacttctaacatgctttcttctttattactagtattaggtaacaaagaataaatattattttgcatttcttccagttcttttattatatctacattttttgattgttctagtttatttttggtgctaattaagtttttataatattctctttttagtgcatgcttctttatcttctcagaataataactaatattactatttgaataacctgcactaaatagttgtgctaaataagatactcctccagcatctattaggtcatcatttttttgtaaatattctgatagcgtggtaatagttatgggagcattttgtatatataaattgttcattgcatcaaataaaatttgatgtttaggtaataaaaaatcctctgattttatatctgcatctactaaatctataattgcattattatcgcttaatagtatggctaataactcagcttccatctttatataacttaaatcatattgattagcaaccaattatatcaccacctatgtaagcagtgttacgaagtctatagtcgtattccttaccaataacttctattacggtgtcacctccattgcacatttcacttaatctacctgcaatacccatattgatattgactatgtcatttaataataaggtactaccaactaatactggtaaattattatcatatctatattctagaatatcaaagattattctttcatcggttggtgtattgtctttcattaaaaaattatcaattattaaaacttcacaattaagtgcttctttttctgttgtagtattaattttagttattctatcgttttttattttatctactaaattattgaacttataatatcttacatctatatttttatctaataatattctacctatgctagttaatagatgagttttaccgcagccactttgacctaataaagctgcagaatggatgttgttattaataaaattatttaaaaaattttttgcgttagaatataatttcatatatattttattttcagtatatttataattctctaaagaatatttttctaacatatttaatgtaaatccatgagaaatcaatactttttttcttttcttttctatttgacattcacatacaaaagttgttccttctgtcgtccaaataatgccagtatctttacatttttcacaatcatattcttttatactgcattggtctaatataggattttctttagaaccatattcagctaattctaaaattttagctaatagattgtttttttcattttcatagtttttatgtttgcacataaaatggtaccccctctttttgtcttattattgctactcgagtagcttgcttttctttttcctcatcagttaattcagtattgtatttattcaaccatgccagttcttgtgctttatgtctctcaaaatcattttcataatcattgggatcaataagagtatcttttataaattcctgtatcattttttgttctctcattttacgtatatgttcggacatttcttttgcttgtctatttaatgattcaaatttagattgtttattgttatatttgaaattattcttgttcgcataatatttatttgggttatctttatcccattcattcttattctttataattcctgtaacataactaggtgtccagatatttttattttttgctatatctaaagcatcccttatttgttcataatcatgtttatttgctaattttaaatatcccttaatataggattgagggatgttttctaatcctatattggcatctatttcgtctaatattttcttttgctcaggttcaatatttttatatacttctaatttgttattttctctaatttctttatctctctttctttttctatgattatatagtatgcttgctacatagttaggagaggatatgtttctatcaaaagctttatctattgccttttttatatcttccaaagggaatttttctctttctaacaattcatcaaaaaataattccttggtaaaatagtttattttaaagttcttatctatcatgtatacagataattcctgtatttctctttgttctattgtaggttcatatttttgaactttatatatttgttgcggatcatctttatctatcatttcttcaggggtttctaatattttatatatattggtttgatttttatatattgtatattgttttgatttatttgctactaacattttttcattactttttctaatttgcttagtcattaggcctaatgcttctaaattttttattgcatcaataactgttgttttagatacgtcagctctatcagctatagtatctaatgaaggataacattcattacttttatttgaaaaagaagcaatgaccaaataaactattttatgcgttgcttttaattttttactatatatgattgcattatctattgatgtaaattttaatttgtaatccaatatattttcccccttgtttatgatagaattatcttctttaatcaatctatataatctttataatgacttgaccaccaatctggaatatgcttatattcatcttttatccattctggcataccaaaaattgatataggcttgatttttttatcttccgttatttgataatctatcaattcacattctttaagtctttctagtgcatacattacatttttatcgtcataatcttgtttaccaaaatatccagccaatcttaattgtatgaatcctgtaagttcttgccaatataaatcatctcttactaaatggtgagtactttcactaaaatttaataatattaaatatattattttttcatcagctgttagctgtctagtaaataaaactcctaatggacaagaaccttctcgatcacttcgctcatctaatacataaaaatctttattattatccataaaagcacctcaaatcattttttaacaaatctgcacattttttgattctataactaacagtactttgagaacagtttatattttgggctatatgttcttgagttttattttctaatagtaactgctctaatatatctttatctttttgattgtgaattttatttaatgattgtcttatagtggtggtatactctaagttagataattcattatttctagtatctatattgtctatgtcaaaaacaggtctttctattttggctcttctatatgcttttaaaaaatactttttcatatcattttttatgcacacatatatatatccttctaaagaccctttatctttgttaaaattttcgtaagattttaatatggcaattcttcctatttgttgtagctcatctaattcaacaaaagaatattttgccgtatattttttggatattatattaattagttcttgaaaattgtttagtatagtatctatatcaggtttatcattatccaataaagaaccctccttttcaaatgtaaatatgaacaaattgttaaatgtgttactattatataaataaaatattatatttctattataatttttaattctttttttacaacattaaatataacagttttaaaaatgttaactttttttacaaactatttaaaaatttagatatttattttaatttgctcaaaataattcatagaaaaattatttactttgcgacagcttgtttcataatttaacattgaagaacatttatcgtcatttaatgctctattttcattaatttccatatagtttaaatattttaatattttttctaatttgctttgcttagtatgttttctttttgtacacattttctttatttctttattgctttctttaatttcatttacacaatcaaacatcaattgatctccaagttgaatcttattaacaaaatttatattattttgtttttcttttttcgtatctataatttcagttccttctcttaattttaaataggctaatattgatttaatttttctacatatttgtgtttgggatacttccctctctattgctatttctgtttgacttttatctcttaagtaatagtctataattaagtttttatcactttgaggtaatttatttaatattaggttaatatgacttttatttaccaattcatcttcagcgtttgtatcttctatattgtctataaaacgttgctctttttctccatcattatatataatattatctaaactattgctaacactatccatttcccaacctttctgatagttatctcttatgtgtaataaaatttccgtagatatgattttgtttgcatatgtgctaaaattaatgtttttgcttatatcatatgtattaaatgctttccatactgctaaatgtgcaatttgtttaatatcttcaaaaccatattttatccatttgtaagcatatttggttattaagttagagtatttttttagtacttcttcaaagcttaatttttctatattatttttatttacttttatatctttcttcattaatatctatccccctattattaataaaatatgattttatagatatacaaagccagagatacgatatacttctggctttgtataatatgcttatatagttgttgttttgattaatcttactaatgtaccagatactctttctctttcacgatctattctctttattcggaccaaataggtatcaccaatattaggattaaagtttgcccagtttggtggaggacatagtattactattccttgctgaagttcaatgaaaatgccgaagttttcaatattcactatttttccagcatgttcactgtttttaggatagtttttttctactatctctattgggcttggttttagtgctttcatagataactgtaatatttgattttcagcgtcaatctctaatattttagcttgtattctatctccaacctgagcatattttcttaaatcttttatatatccataatcaacttcttttttattaatcttggtttccagccccataaattctactactatgtcggatgctccgatagctacaactctacagctaatcgtttcaccagcttcatgttttattagatctgctttccttttgatttccatagcagctaatcttgatgctacagctattttttcatcttcttggatacctacaactataaaatctacttcacttcctactaaactccttaagacgctcctatcatttctaacattcataacaaatgatgggattattattttatagccatcaaaattttgtattattgcacaatccgtaggtttttcttcaaacaatctttcttctattccagttatgtgtgctgttaatattttttttgaatgtttacttgcaaaaatttctcttcctttattcatggacatcttctccttttatgattgaattttcacttgcatatatacaagaactgaaaatagtatctaaaaaattagctcttgagtatatttttttatatatacaaaattaagtatttattattcctttttaaaaaattgttgcaactaatttttcccttcatatgtatatatacaagaactaaaaaaaatatctaaaaaaattagattttttagcatatttttttcatatatacaaaattagtatttattattctgttattagaatttattacaaaaaaagaacagtagccattttaattagctactgtaggaactagtaatatatctccaggatatattacctcccctatattgttttttatttgtatttttgtcttcattttttttactgatattgtatcagtagcatattttttagcaattctttctatggaatcaccttgttttactttatattctttatattccatactgttattattacttaataattttttattttctatttttatagttcctaataaactaattgttaaaattgttagcaatattgcaatttgttttttaaatgtttttttcatttttaaattcctcctaattttagctatatttaaccatcatttatactctaattagttattattactttttaatttttttgttatataaaatatagatatttaaatatataagaaataaaagcagcaaagctatttaatctaattagccttactgcttttatttttccttttagaagaaggaattgtttatctaataagccctcataaagatatatatataaatatgctaaaaaattaaaaatattttatatctatatatttatatatacctatcctctagttagggtctaaaatttgtaccctatttataaataactttgaatgcatttttattacctagtcaatatatagatatttctttaatattataggtttctgatccctaattagtaaaatattattatttgaattatttaatttatctatatccaagggtttgtttaatgaattagatatataatctatagtatttttagaatgaggactaagaaataatttactatcacaaagatttagaatactatccatatcttgtagctgcattgtattttgaattataatattaaaataaattcctttatcttcgtaattagttatataggatgcaaattcaggtatgctagccatattgtgaaattcatctagcataaaatatacttcattagaacatcttccatttttattagcataattaaatatatttttatatacacatgtaataaataatctacttaaaaagctaaatgttgcgggtgaaggcatatctggcgttatacaaaagtatgcgcatggtctttttgcaggagcgcttagatctatatcgctggtctctgttaatgtctggaaagattgactttgaaatacttgtagtctagttcctaattctattatcataccgctccttacattatcagcactttgactaaacaatttgtatggctgcttagctggatgatcactaggtagtgcgctaaataatctgtctatttccttaacatctttgtttgctaataaagtatatatttcttttggggttcttttccctttaggtgattcatgcataacatataaagttagtgcttttaataagttttgttcttcttgctcccaaaacttatcaccttttgaaacaatagatgttgtattatctattattgcttgtgaaaatgattcagcagataattcatcttttacttcacttaagggattccatctatgagaattttttgtggacagcaaattaaatattttaacctcatatttttcattgattagtttattttttaatttagtatacaattcacccttcggatcatttattattagactctttttatgttcagccagctgtaatatatttggtaaaacatatgatctagttttaccaataccagcaccaccaaatacagctacatttttattaaacttacatgtattaaatggtaaagctacaatcttattatttaaggctccacatattatgccatctgctttttcatcaatatttaatatttcttttatttcttttttattcatcaaattattattaaacaaaattacatcactcttttcttttatttatctataaaagttatagatacaaaagaaaaaaacacaccagtttaataaaaaaattaagttggtgtatttttatattattttatttagttgaaaaagtcatttagtgatatttgatttgaattcttattagattttttattagttttcttgctgctagtagctttttcattttttatcatatcttctatattattatctttaatcatattttctatatctttatttattgaacttattggttctatgtcatctataggagactttttgtgataagaaaaatcttttccttttgaccattcgggttcaaagtctgttatttctataggcttaaagtttttgcttaatggatgaaattcgtaagaccttttatctagaattaatggtttttggcctttcagcattagtatttccttatctgtaggaaactgtaaaatttcatctggatttaaaagattccttttagttgctcttgttgtatttttcccaaaatcgaataatccttctaaaccgccacttttgctattcgaggaatcttctactgttgttattcctaataattttgaaacaaattcagctgttaataaatctgtacatcctaaaaataatttactatcacagtttcctattatttcggaccatccaaaattgggatatctattttgaagctgggctatattttggaatataacatggcaatggactcctctagatctcattgtacttattttcttttgaaagtctggaatacttgctatattagggaattcatctaacataaaatatacttcaggatcacatttaccactatgcaagtccgcataattgactaaatttatgaatagaaatgaaaaaaataatccacttagaaaatcaaatgttgaagtcatatctgatgttatgcaaaaatatgcacatggtttttttgcaggagcgcttagatctatatcgctggtctctgttaatgcttggacaagttggttctgaaacacttgtagcctagtccctaatcctattatcataccgcttcttacattatcagcactttgactaaacaatttgtatggctgcttagctggatggtcaccaggtagtgcactaaataatctgtccatttctttaacatctttacctgctaataaagagtacatttctcttagatttctttcgctttcaggtaattcatatataacatataaagttagtgcttttaataaattctgttctcctttttcccagaattcatcaccctttgaaccaacaggttttgtattatctattattgtttgtgaaaatacttgagcagataaatcatcagctacttcattcaaagggttccatctatgagagttcttcatattaactaaattaaatacttttacatcatatccttgactttcgagaaatacttttaaatccctcattaattcccctttaggatctgttattactatgctttttttattctggacaagttgacatactactgttcttaaataaaatctagatttaccagtgccaggagcaccaaatatagctacgttcttattaaatttccaagtatcaaatggcagagctacatttttcccatttaaagctccataaattattccatctactctatttcctatgtttaataattgttttgattcttcttcatccatccaattagcagttccatgtgttccgttatcttttaagtattttacattattatttattccttgtttttctttatttaaaaaaactattatgacaattaatatggctgcaataattattatagaaaatacagataaccataagcttggattaataaaaaaatactttaatgtagtaaatggttttttataaagttcgttatattttaaaacctcagttatttttcctttattcttagggtctagcatatttttagttactaaaattgctggggtagtagcatatatcatggagaaaatataaagaacagtgtatataatttttctagttgatttttttaaagccttttttaaaatatttaatatattcattataaagtttctccttttctactaggacaagtctcatactctataggaagaatatttatattttcatgtagaactgtcttataatattgctccattccccttagacaaaaaacattgattttcttatgtgtaaaattactagcaaatgaatttaagtattccatttttgcgatgtctataagtaatagactggtatagtaattgctttgatcttcatattcaaataaactgttgctacaagtgaatgcattcttcaacagttgcaaaacttccatattaatatccttagagccatattcatttagtagtttaatgcttaacttccctgttgggacaagtaacaagctatgtcttcttaatgcatttataggcatttgttgtattattttaaagctatttataaaaataattactttagtacaaatgtttttatctaaacttttaatctcgtattgtgcataagttaattgttttttatttaatctattatctaagtgataaacaataaattcttctttcctatcattagttaaagaacctactgtttgacatacctgatttagatttttactagtttttactgcttggctattttgtatttcccaattatctaattctgtgtatatgcctgctattttggacaactttcttgctttgcttttatcataaactggaggatttatttcaatatttaattcttttaatacttccttgctcttatatcctaaagtaacaaagccatgcttacctataacataattttcttcttttaatttcaataatctttgcttatagtattctttaccataaaaattctgaagcccccttacattcagtgcaccaaatttgttcaatgtttttaaaagctttatgtctcttgcttgtaattcaaccatctgcatctactccttttattccggttttatattcagttattatttcatttttaaagttttgggtgcacctatttaaaattttgcttaccattatcaaaatgggatattatataactaatttgaaaaaggagctttactttattttgctttatacatattcttatagttttaatataaataaattggggaagtgcttttctaggagctatgcattttatatagatagtgccctactcttggaaagataggtatagaagagaatgtatatttttagaatatcttttcattatatttattaaatttaagatattttttcagcatagatagttatcctacctatttacgaaagtaaaaaaatagctagttagttagatgtttataaagttatttttaaaaaaatagttatatattaaatttatattaggacaagaagcagtttaaagtaatatattatttataaggatattaagtaaaaagaataatatagtatttatatattttttttaaaagctatgttaagagaaataagaatagcaacataatataggacaagtagaaaagaccatgaaattatataaaaatataattcatgatctttgtttggtccctaaagatttataatattaattttattttcatatgttgtaatgaacatctcggtgtattcattattatctttttcaatatcaactccatctaccatatagcttaaatgtttataatcatcgtcaataattaatgcgctatatcttatgccatctataagaaacttaataaagcgattttctacatcggaccaatgtcttatgtgaaatttgatttttacaaatattttctcatgggttttctctaaattaagagatttaatagcatatacaatagttcctatccaatattgctttataaatgtatagtcttttttacgtatcttagtaggtaaaatgcctgcaattttaatagatatgatattattttcatattgtactttatgatttaaaacttgacttttatctagtggacaagaaaagaaagcagccttttcagtattataatttagcagggtatttactataatttgaagattgtaagttatagaatataattccctataagaatccaataattcttcttcttggggtactagatatttagaaatgttattactatattgttcaagttctggaactaatgatttaaccttattgagcaattcatctatctttaatttattattaataatataggtaaacatattcaaatcattcaaaactcagtgcctcctaactagttaaattatgtcctacgtgttaacggatttagcaaaagatttcataccatttaagaaagcctgtttatcaaaattatcttgttctttctctatattagttttatcatcagtaacagtattaggaactatagttgtggttttatcatcagtatttactgcttttgtagatgcgttacttaaaatgtttactaaagctttcaatgaattgtctatgctatctagctttttattcaattcaattaaagtagtatcatcattatttttatttaataattcattccttaaagctctctttacagtatctgtcctatagcttttaggaatgttaagatattcattttctaattctttttcatctttattaaatctaaagcttacaggttgggacaactttaaaacctcctctaagatatatgtatacatttttcaatatgtatacatatactgtatacaatgtagtaaatattattagtatatatacattagttagtaatacaatttgtgtatgcaaaagaaaaataatgatatctttttaaaagattcgtatacatttttattaggaaatactatttcatagagatatgtatacatatactgtatacaattttgtaaaaagttattaatatagctagactgatatgtattacattcattgtatacaacttagaaccatatgtaatgattaattaaaaatatgaaaaatataatatgtacacatatgttgtatacataatgtactgtatatacttatatggctagctttacatgtattttattaaatgtatacaaatcagaatataaataactagctaatatatatagtttttaattaaatattagctagttataaggttatttgatatgctatttaaattgtttaccaaattctaaatatcctatagcattagcaaattcaggattatcaattaattggcacatattaggttctattaattttagatggttgtacaaaaccttaccaccaccacctgctatcataatggaattaaaggaattttttctacttccccatagtccatcagctttattgataatatttgtgcttaaggtctttcttgctttaattagatctttttttaaatcaatgtagtctcctttgaaaaatattttaccttcctcacataacagcattaattgctctgtattcagcttacttccatcacgagaattatctgtaaaagctttatccatagtattatatatgtttatcattcctagaccgtccaaagtagcagacatttcttgttcaaacacaggttctttatctttgttaattctaaatacaactatatctgtggttttaaagcctacatcaattaagcctataaaagtttctttaattaataaagaactgatatcattattaattttagaaaaaattgcacctgcaccttgaggaaataaagtaatattgctttcttcaaactttatgtttctactaaaattatgatctacaaatttaatagtatgctcaaagtctttaagcatatcatttaatgcctgtttttgctttataaaatgttctaatggtaatccagtgacgatatggattttggtatcattaggcagatcattaggaattaataatcctagagcagtagctagtaaaactttattttcttctgaattaattttattgtctctattaatgaaagatgaattgctgggttgtcttttagccaattctcctacaaaatattctttttcattaaaatattcatctaatattttgacatgtatattatctactatgttatctattgaattaaaaaatgtatctaaacttctatctttaccactacttattattgaagggaaaataactcttttattatcttgattaataccttttatttgtccatagcctaaatctattgcaatcgtatatttattcataataaacaacctccttaaaatatatataattatatatactatttaaaatttaattatgaaaatataatgttattcaatttattatatattcttgctctataagaaagagtaagttatttattacatgcatttatttgttaattaaaaatagtgtaataatatatcccactaatataaatggaacatacttagtacaaatactattaagcttttgctttgtaaataaggatttaaaaagaatatatatgatattcagaacagatgatattatgattatgcttaatatattgtatcccatgattaatgataaagctgttaaaatacgaacatcagctcctcccaaaccatatttgccaattaaagcactaaatatatataccgaatataaagcaataaatataactagtgcagcataaaaattatttttgaactgattattaaaaatagaatgtataacaccaatagcacctaatatataggaccaatagttttctatttctcctttttttagatcatatattgaacagatagataataatacaggaattattatatataatataatgaaagacatgattaacctaaccttatattattaagagttgatataatatctggttttaatagaaagtatttaacatttaaattcaataaaaaatctgtattattatctgttaatagtataataactttatctaataaatctttatatttagtaacaattctagaaacttcacttttggatccagcactaataattagtattgcatcactatcatttaagatatcataatagcattcattaattaataaatgaggcatgtctataaaaatatttccttgaaaagaattttttatattagtaataaagcatttatctaagtattttatagaattactatacataggtgcttgtaatattaagttattattagaaattgataaaacactttttttaaagtctttctcaagtaaaaacgttgttatatttggattctgaggcaaattcaacatgaaacttaaatctgagccaccttcttgaaaatttaaatctataaataatgtattgcttatagaatttataagattatatatataagttgttttgcccattccgcctttttcagaagtcatgataatagttttattatcaaaattaagagattgagctttaggcattataatcttatttttgatattttttgttatattaaatttattgttatttattttttcggatatcataaaatccttatctttagccttataagattcttcctcattattaagtgatttttgagtatctatagtttctgatgatgaatgtttaacctttatgtttgatttttctttctcaattggaacaaaagtttgattttgtgtaaatctagctttcttattagtactagaataatttatatcattcttttctaatttaatagattttttagctatattattttcattaactttcttgataaaatcatccaaatctataattaaagttgtatttacaatttcttcaatattccattcaaatgaattatctataattattttggttaatttattttttaatattttactccaaatattaacagaatgctccgatgtaacaattatcatgttttttttattatatatagctttaacattattaatagatagggttagtattataaacatgattaaaacaacctccttacattgcaagtatttattataacctttagttgtattggtatagcgttttgttttaatcttataatagtttcattattgaatttataaggtttatagcaatatcagatgagtgttgccatacttccaattgagtttcattcttataatgaccgttgcaaatacccacattaggaatattcatattttcattttcatataaacattctaatgaggctaaagcaatatttctggtcacatcctttaaaagtccatgtacagcatctttattaatagttgctttttcatagatgattactttccctatagttatattgttaagaattatactatattgttttgattgtttaaaatccttaattatatcatcttcactataaacaacaaagcaattttggaagtttttatcaagaatatcattatgaagttttctatccaatataattgtattaattaatgcgatgttttccccacaatttttacatgtcccaaacatcatcgctgtttctgcttgtaaccaatactttttaggaacattaattgtgtcaccatcatcatataaataatcttgggtgcattcacattgtttttctccatttgttagagaaaatttaactaaatgatttttacatttagggcaactaaagtcaattactgattgttctttgaattcaaaagtttgctcattatttaatcttatataaacatcattgaaattcattgatttatcactcactttcattttttatttgttaatatctcaacgtgccgtactttacattcattgtttttccaaaacgatcatcaacacattttttaaaaagccccttatgtattttatatatacataaggggcttttttttaatcataaattacaatatttattatcttatttttatataacattagttctccaatatgatcacttagattatgatatgcttttgagtattccataatagagttatttgaaactttttgaatagtgcaattaatatctactgctaattcagtagtattatctagctttaatttagaatctgcaacatccattattttagcagtatatatatatatattttcttttacatctgtacgcattttttctataacttttataccattataaataacaatatattcttcaccagtattaagtttaccttgggatatttgactattaggctttatttccttgtccccaaaaaatactttgtctttagtatttataattttattattagataaaattatattattgccatcatatttctttactgtatttaaagtatgtttttttttagtagaggaagatgaagaattattatcattataaggagaacggttgttattttcttctaaaataatcttaggattattagtagtattattagtatctattttaattggttcattagatttcaatataattgctccaatcattgaaataaaagcaacaattataccaataataaataacgctctaatatattttttatttttaaccatattatcaactcttccttgaaatattttttattctagaatatccgaagaagtcaaaggtttgtgtagtctttacttttttaaagccgcttggagttaatttgatatcagtataaggaaaagtttttctacattctagcttaacagaattaccatttggccttatagcaatattaactccagatattccttgggaagaaaatactttattagctttgttaattaaatggtcattattgttccaattattaggtaaagaaccgtgtgatatgatatattgcttattggttgtatatacttcccaggctactgttctggcagccatatctgctgtttgatataacttattcctataattaaataaaattaaagcgttatattgaaacatagccataatgaaagctattattaacagcgatatatatgcaaacaataggctagaaccttttttatttaacttaaattttttaatcatcataaagttcctccgttttattgcatttcttcaattatttgcgatccagatccgctaacagtttgagaaggaaatagtattgctatacttggaactttataagaaacagttaccttcaattctttacctatacttccacccccggatgtattaacaatagcatttttattccaattacttaataaaccagaaccataattattgacagtttgtttggcaacggtatgagaaagtgctggtccaactctagatcctgctcgagctccttcagcggcagtagatataactacattttgagcagtactgagcatcataatttgtattattaatcctacgagtaatacaaaaataaatagcattcctgcagcttcaacagtaccagaaataccttgtttatttaatcgtttaatgattttttcctttttcttatttgacatgctttaccaccccttgaataacgccattttttattaaattctaaaacttgtcttacttcataatacaaatctttattaatgctaaataaacgggaagttacatctaaatatatagttgatttacttatgttaaatgctttagcagttgctctaatagtatgcttagttgttataatataattagcttcttctataatgcgttcttgcactttattacataaggacatataaaaatcaccttctaactttataaataattattatttcaaaatttttatttattttatttatatactgaattattaataaaaaaaacgaagagctaggacaaaatttaaattttattctagctcttttagttagtttaatgaaattacttttaatgattttactgcgtatttgaattaaagaaatttctagcattagtagtaactgttctccaaatacctgatacagcatcttttgcttgaggtactactaatataatgcaagccactataattgctaatacacctgctacttcaaccaattgtgagataccttttttattcatttttatcttttctgtgtataagtatttttttgtacataaattagcatatttatgatatatataattgtttaatttatttttcatattgtaaaacctccatttaagtttaaatttttacttatctataaaagttataggtgcaaaaaataaaaatcgtactattttaattaaaataatacgattttttataaaatattttttattaagtttttagagagaagaacatgtgcaaacttggtaaaatggctagtagcggtcactttataaatttagaatcaacggattgatagtttgtaatatgtttcttaggagccttcatcatctcaccatctttactaaagccaagtaatacaaccatcgcaataactaaggaaatagctaatactcctactaattctactgtatgagaaatacctttgctattcatctataatcattcccttcagcaatataatatttaatctattataattataggtacaaaaaaagattatacattgacttaatgtataatcttttttattacattccttgtaatttagtcatttgtctaagtaaaggcactagaatcattataattagaggaataaaataacctattaacatagggaaaaacaatgcattatctaatttatcagcatgttctgttttaatatttattctttcttcttccatatcctgttgcaaatattctaattgcttatctaaattcataacacttctatcagttttttctataattaaagccattcttaagaagtaatcatttaggcttttttcggctacttctcttaaggctttattaatatccataccagaatttacttttgttacacagagatttattaaatttgcagtattaccttttttgttatttgaaatatatagtaatattgaatatacaggcatacctatttgaagaccttgtataagagtttctaatacagctggtaattcattgtcttttaaaaagctttctttgtatttatctataggatctttaattttagcatataacaaaatattagtgcctataagtaatataataagggccttaaaattgctcctatttagaaaagctaataataatataattgatagtatgccccatacaatagcaacaaaagaaaatagttctgatacagatgttatttcaataccaaatatatctagtttcccaattgcatgcatttcacgattaattttgtcaaacttatcttctttaattactttttttattattttatcttttaaaaatgggttttttattttcataatagttcacaccctttttataaaatagttacttctttattaatttttctaaatatgaatactgtagttacggtataagagatacctgtaattaaagctaatactctaccgaatggctcatgtaaaaaatccttaaattcaggagagctaccaaacatcataaaggccatacctaagagaatgatcataatcataatcgaaataaattttagacctgataatttggcattaagtttttcattttgtgttaatctttttcttactttggcagaatgttttatacataaatcagaaacatttgctcttttatcattagcaaacaacatggaatctacccaagtattaactacagtactgttcactctataatcaaaatgctttaaagtatctaatatattagtattactatctatttctttaataatatatataaactctccttttaatggatacgctatattaggagtaacatttttaatggcattgcttaggttactatctattcttaaataatcgcctatatcaataagtgcattaataaattgtttatttatctctattaccctatttgtacctttatgttctatatatgcatatcctattgatcccaatacgataggaacaattaaagatagaatagtgttgttaataataattcctataatcaatattaatgtagctattaataaataagaaaaaataatgttttcaacatctgcatttatacctgctttgagaaatttacgttctattttctctatatttatattaaaaaactttaaaatgctaaatttttctttgcggcttttatctgctaattgtctttttaaatcattttgtattttatttaccctatattctttatacaaaataaaacacataaaaaatataaatagacttatagctaataaaaatgatattgctaataacacatttttactcattttagtgcattatggttatgaaaatcgtaatataacataaccattctcctctcattattttattcatatattttacgatttttttaagcaataaattataatatagaattatttcttatttaatttttaaaattattattaggaataaatgttactttcatatttttgaagttagttaaaacacattccttccaaaatttcatagggaatgtttgtatatttaaatattctgaagctaaatcatctgacagtaaaagtaagcttttaaacaattcaatatattttattttaaaatcaataagagttttgatatcactgatttcatttataacgttaaaatttattgaaatacataaaacatcattattttcaatatccttatagaaataatctatattttgtatttcattattataaaaagcatagtactcattatctacaactttaaaaacacctaatttctccatatgggaaacacctcattctttctattattcaatatagttttttaatacatattttgttttataagaattatcatcatttattccatgaatttcaactatttctttaatcatacgacctatcttatttccatcatcatcttcttctaaagatagaaaaattactatatcaactgctttcgaaattaataatcttaaagttctatcatccattggtttatgttcttttataagcatttctagacgttccaatgataacaaagcacttttgctatgaatactggtcatgctacctgtatgcccagaatttagaacatgtactaatgaataagcactttctggtgtacgaacttctgtaagcataatcctatcaggattggcacgtagacaatcatttaatatatcttgatagctaatgggcttacttccaccatcagattttcttgttttaagataatatacataaggtaatggcaacaataattctctagtatcttctaaaacagctactatgtgatttttttgtatataatgcgttaatccattcataaatgtagttttaccagcaccagtatcaccaacaaatacaatattttttctttggataatagcttgtttacaatattctctgatgtcttgattttgtccaatttcgattagattttcagttttatttttagaaatcttttcaatagctggttcttttattgtattaataggaagttccaatcccattaatgctaattcatctaaagatgcagatgctaaattatgttttcttataattatataaggctcaattgattcaggaggaataattaattttacacgagagccgtccaataattcacagtcttttgaaggttcttcagtagatattgatatttctgcatcagaagcaatttttttataaataactgttacttcatctatagttaatttttcaggtgctaatttcggtgtaccattttctatatacatgattttagtgcccaacacaaatacatctgtaacatctgacaaagctaggtatttatctatgacatttaacccatacatttttctgtaaacttcttcagttattctatcaatagtgctgtttgaagctgcataagatctataagcagatttcaatagatgttgttttattacaatccttaattgaattttcaagtcttttccattaagatctgaatatcttaacattataggtctaatagtttgtattaataatttgaaattaaaatttgttaagtctatttcttctttgtttttataataattcataactatatcacctcagtgtatatctgatataacgtgtatacaatagaataaggcttaatattaagccttattctattgtatttattagattttctaagctatttttgatattttgcaccttgtttttttctttttctataagcttatttatagtactgtattgatttttataagaaagtatttcttcttctttttgatttataatatttattaaatttgcattagtagcttccaattttttgttggtagtttctaagtcagttattttttggttagcattattcaaaatttctactatgttattttgaaatgctaaggcttctcctaatgaagcattttcaaatgtagattcagtagatggaagttcagtataatttgaagtattattgataatagcttcattattttcctgaaattcttgagatgtgtattcatttgtatttgtaatagtatctactggcttagaatttgacatattattttcatttgttacttgctttacatattcatccatatcatcattagtattaatttcatttgattgttcaacgatgtaatcagatgattgattagaagtaggtcctatattaatttcattattatttaaagtaggattttcttcagttacaatatttttattgatattatcatttccattaaatagttcacctagatctaaatttttgatatctcccatactatcctctcctatgctatttaagttagtgtttacagatggtaaacttaagtgatcggtatcttttttagttttttgtttgaatttctctttgcctttaaacagttttgaaaaaaatccttcttttttatctttatcatcctcattattatattgaggaaataatgtgctaaaagtatcatcaatatattttaaaaatctttcatcattataaccttgaaaatttttaaacagtggtacagtattcaatataggcaaatataattcagaatttgtttgttgtaacatagaatttgttagaaaatcatctttttgttttttagatgctttattaactaatatttgcattttatctttagagaaataattacttttaattccccactcaagattaccgactgctctacttactatttcataattattatttagtactaatagaatataatctgatatttcaaaaatatctatacaagaatctatgaaatttggctgtatatctactattacaaggtcaaaaaattcgtttaattgttctaatgcatttctaacatcagttgacgtgaattgtgatacataatcaggataacctgctataactactttaaaattttcagtctttggttgttgtatagcagtatctgtatatcctgctattaaatctaatatattttttgatatatctaaatctaataatgtaggtatatctcctggcgaaaaatcaaattctagcacacaagtttttaggccccttttttctgctatcttagctaatgctagactagtagttgttttaccaactttacctgaagggcaataagaactaattatcatttttaaaaatcacctaccataaaattgtttttgaatatatatagcatatatactaaaagataataaattatttctatttagtatttgtatttggcatatctttttcttttgtagaatttttttgaggtaaaattataggtttatattgatcttgttttagataaggtacaattttagaagcattggtgtctgttgttttaaatgcaactaacaccttattgttagtactatcatcattttctttttttggtaattcttctatgcttgttataattaagccttttattatttgaggattttcattagcattattttctattaatgctaatgctatttcatcgcctgtactaattaacttagcatcttcacgaggcataaaaattgtaagtagcatttcattagattttaatttaattgaagtatctccaattattttttttggtataaaatcattctgcaatctatcaacttttaatgatttgcctacgatatcttttgggctaagtactatatcaggcaatacatttttattagatatctcttttgtttctacatcttgttctgtaattattttgcctttattaatatcattttttagcacagccactttagtagtaccgctgacatttttaagtattatataaaatactgtgaacaaaaaaagaataccaactataccgaattttaatatttttttcattctactaaaattctagctaagaaaatttagaaaaactcaactagatcctccttctttatttctctatttattttctaaatttttatttgaataatagattaaatatctatacaattttttctattataaatttttcaagtatagataataattctctattatttaattgattagtattttgaatgtttaagtttagcaaagtaaacaaattaataatttgctttttcaagtttatatcttcagaattaattaaattagaatcatttttaaatttaatttgtccacttacatttagatataattttgctatttgagaaaacattgttggatattttaatttcttaataattttttcttcattgaatggatcaaaaattatatcataaataccaagtgctaacgcataacctaaatattcagagtctttatcacctaataataaaattattcttatttctcttttccttaactcatataaaaaatcctgaaatgatatgcttaaagtagacatatctattaaaggtgagataatgactatatcaacagtgttttctaataaatatttgggatatatactaattaatgaatcttttattttagattgtatctgatcatttaattcatcaataccagtcattatagcaacattcatatctatcactccttaaattattatttcattttttagatatatacatattttataaaaaaatttcaaataaaaataaaaactatgtctaaagtaattttttactctaaacatagttttttcttattttgtatatcttctagcccctacatagtctcctctggtagctaattttgctatttttacgactttatttcgtcctggggcatgaatataatttccaccacctacatacatgccaacgtgacctggtgctgtattagaaccggtacttctaaagaatactaaatcacctggctgtaaagaggacttagagatagatttccctgctctaaattgttcttctgatgttcttggtaatgaaataccacaagtgttataacaatataacattaaaccagaacaatcaaaacaacttggacctgtagcaccccatacataaggtttatttaattgttgcctacaaatactaactactttattacctatagatgagccgccactattgttagaagaaacaatcatggaacctttatatttatcagccatatcaaatacacccgttttgtcaggtcttcttaaatattcactataagcaaaagaacggcttgtgccaccattatatgcttgacatcctctccaaatcttttcttcccatcctttaccggcccaatctattctgtcttttttagtatctacatgagaaaattctttgattttttcatatagttcttgcatgcctaaatgtatttgagcatctatacttgatagtgcatttcgaggattggagatgtgtaaagctttagcttttctatcccattcagttgtttgcattaatcctacagcacaagtagcttgtaagctataatcatttttcacttcagctatagttagattactccatttaccagaaccatatgcaactgtaacacagttaggattaaatgaactttccctatatataaatccacatattaaccaagggggcatcttatattcttggcaatatttcatcaataccttcattaattccggaggaatatctataccacctaatgaatcaaatgtaaactgcatggaagaattaccatccaataaccaatctacattctcttcctcatttaatataccttcagataacataaatacttcttctctctctatttccataacggatttacttaaatttttatgtttaaataatttacttaaatatttatcaaatctttcatattcttcacctattaattcattacttgtatttctataatacactaaagtcgattcttcactgttttctacatttttttctgttaccttttcataggtgtacttataatgtccataaggactatcagcttcggttaacaatatttcgttttcttttttagtatcattaactttaatttttctaccagttaaaataccatctttgtttctttcatctatttcctttacggtagttatagttttttgaaaagtcttatattcaaatttaggtgttaattcttttgcgatatcatctaataattttttattgatttccttatctgtactagaattatagaatactgctatagcataaacatcattccattttaattgtaactcttcatctctttttaaagaatcacttagtttatgaacatttttgccgtcaactattgtattgcttttattgcatttttctactatttgttgacaatatacttttagctctttttgtttaatatcttttgcagattcctcaggaaaagtaaagtagaagaaatctataattgcgcaacaaaatattaagagtaaaataaatggcattaatataattaacaatcttctagcttttttctttatatactttaatatcttttttttcatacggctggactttttcctcagcataatatcatcacctaacctttatagcttttactatcaaaattagggaagttagttttatttttatgattattacttttatgtttaagattttgattaccagagttaaaagattgcttgttagatgtaaaagattgcttatttggtgtaaaagattgtttgttaggtgtaaaagactgctttaccttttcttcagtattactttgattattaatattgttcttattattagtaaaagaatctaaatgtttgttttttttcatactatcatatgcattttcaaatatatttttattaggatcatatcctttttgttctgaataatttgaagaatatgatttatatgcttcagttgctttgtttgtaacatctcctatagagtcaattccatcatttataatattttcagtagaatcaactgaacgattaatcatattagcagttgcattaggattattactatttaatacagcaggtatactagataattttgcaacatttccaacaacgccagtggctcctttagatacttttttagcagctctgataaaaccagtagattgagtagcttgattatctccattgtttgttgctggcttattagtcattgtacttgcaatgctttttgcttgattggaaaatgaagctgcaacacctgctactattccggttgtagctccaacagcacctaatatgccgttagcttttttattttcatccataccagccattttagttaatgtaccctgcaacatatttcttacaatatcggctaatgttacaattaaaattgcccatattaattgagctgcccaactatgctttgcaacaaagactaaatataatgaaaataacaatgcataagctgattgcataaatatattagataacatttcgcctaaccatacttgtgcaccattgatatttttgtctataatccagagtactgcaacaataggtgttagaacataatatactattatagaaaaatatctaataagaaatactatatttatttttatacctaaaaaagagaacataccatacagcattgcagcagctaaaggactatctgtatctaaacttttaattaggtttgctccgcctaaagttgtatctaaagttaccttgccattatttaagagattgtagaataaatatgttaattcattattaatatatattaataatcttataaaaagaggggtagctgctattattatggaagctataagtaatcttacaagactatctttagcttcctgcttgtaatgagcattataagatgctctaaagaattttaaggctatagcaaccgtagctataactattaaaaaacatgcaatagcagttgaataaccaaaccatttatccatattagcccaatctgccttaattattggagaatatccatcaacagataaacctttattaaacacgatattatctaatgtagagaattctgtttgtgaattaataaaacttgtaaatccacaaataaagctaataattagatttgctattattttttcaaattttccagcaccttctatattgtttatcgcctctttagctttttctttttcttctttagctttttctttatcaggtttagaatctacttttattttttgtggtgttattccatcacctttcattactgcatctgcgtaaacaattcctattttgtgttcttttggtgtcgatatagtatttatataagaaggtgcaataatattaatacatagtatcattagaaaagttaatatcatacttttaaatacttttttacgtttcaactaaatcactctcctattatgtgtttataaattattatttcttttaaaaaaaatagagagtaatttttaaaattaccctcttcttatagacttaattatttttttattatttttaatatgttttttcataaagctagaagcgtgacatattgaaacattaattagacttaaaactattgcaatagttaaatagcatccccaatctatttgaggaatttcacctatggatactaatttataaatatataatttagtagtaattgtttctattacattagtaaaaaaattcatttttgatgttaatgcaaattcatatatgaaaggagagataatccatatacataaaagaatttgagataaaatataatttttatttttaataaaaccatatagcataaatactgttaatataaaagcaaatctaggcaaataaaatatagataataaatatattagaataaatactcctaacataaaagcactacctttcttttaataattctctatctattatgtattatagttttttatagcttaaacacaataattgtaaaaatattctatatctatatatttatatatacctatctttttgttagggtttaaaatttgtaccctattataaataaacaaaaaactatatttatataacaaaaacaagctattgaatagcttgttttatccttaaatattaagaagttgttatataagggaattcatatggaataggttctacctgtactgctgtaactgctccttgcatagataaaatacattcaccgttgctgaaagtagttagatactctttagtaccactagctaatccatagtattgtactatttgttcagctggttgtggattttgtcttaaaagaactgatgtagcacaagatttaattacagctaaaccactttcattgtttaagaattcatctatatattgactagcgaataataaagagcatttatgtttccttcctctacgagcaagtacttctaagaagtgagcactttctggatactttacaaacatccatgtttcatcaactgcgattatctttttaacacttttattttgcataacgaatttttgccatagccaagataacaaaacaaatgtagaatagaattttgtaaattcatctgttatatgagataaatcaaatcctattattttaacatcatctggtaaagtactttcacaatcaaacatacccattgaattacctcttaaataagggattaatatatttgatagctcttttgcatctggctttttacttaaatttttatgaaaatgacttaatgttggcatcttcttttttactctgccgacagcataactgccatcaggtaacttagtgccgcctttttgatataatgaattaatatctttattaattccaaagttcgcgtaagtttctattactgctgtttctacagctactagttcaagaccatttaatggtcttccagatgtacttcgcataatggaagataataaatcctttatatcacttactttatccattatgggaacaaattctacgccagttttctcattaaaatcaggtgatatgtcaaatagatttattccagatatttcacctgctgtaatagttatataaacaccatccattaaatcgactatgctttttctatattctccttcaggatctaaaacagctactttagtacctaaagaagagtgtttgtttatgaaactttttataaatacagatttaccactacctggtataccaaatacacctatattaggattattcaataatggtggcccaatgaattgattaataaatacaggagatccactaaataagtttctacctacataagcaccattaggatgtgttaaatctggattggaaatagggaatagagcagaaacaccatagcttgtcatatttctttcatattcttttatatttggttgacatacaggaattgatttaattaatccttcaatttgacgattggttaacgttctagtctgcattgcttttcctgcaaacatatcttcaatttgtaaggttttttcctgaagttcttctaaagatttagcatgtaatactatacttatagtaacaaagaataatttgtctttattagtttgtacattagctctttcctcttctaagtctcttatcatttcctctaatacaggagtattatatatatctccacgattcatatatacattatactcagacatagcttgaacagatttttttgttagctgttttactactatatcattaggtacagcatcgcaatatacagatagatctatctcacctatattaaataatgcatctagaaaaccaacataaatttttctaggatatatggaaatagcaaatgaacgaatataatgttcatgacctaaatatatataatctttttcttccattattgcttctggagagaaaaaagaaaatttttcaggaacattattttctatattttcataatagttttcattcatttttatattaaaatttgtgtgattcttttttttctttttaaatagcattctttttttcctccttagttccaacatacaatgataagctacctctttgaacagaatctgaaggcttaaatgaagaatttttattcaatataccatgtaataagtcaattatttcgtttgtttccaatacattagtagtgatattttttctttttaaactatcttgaaccattgcacatcttctatttaattcactggaagctttatcaagaggtccatcataactaataatgatataatttttcctaacagatatgtttctactattcattaaagtagataaaaaattagaataatgttttgcatatgaaattctatgaacattgttttcttttatcatgttttcttgaatctcatttatgttactagatgtatctatattgtgagtagtgctgtaaaattgaacgcagtattgaaattgtaaggccgtatctcttaagatattttctacaactgtttgttcatcaatagataacaaattgaaatctatagtagatacagataatattgcactgtatctattatcttttaatatgatcatattgttttttatattatcttcttctatatcccatatattatttattttgtttttgtttatcatttctttatttttggatctattttttgatatgtgtttatttttattgtctaattcagctttcttttgttgtgatttacttttagtgtcattttttataaacagccaagtccccacaactataactacggataaaagcattaaaacgatacttataataatacctattttcacttataccgactccttattggttattttatcttttatatagtaaacacttgtttctttttttaaatttaaggtaatattttaaatgcttatcaaagtaaaggccatttatcttaatgaaactacaactcattgtaaatgctagaactaatagcacaaacaacattttgataaatatatgtatgtgcgtaaaaaaaatcgcaagagaagtagcggcagtagcacagtatcctatttgacgtaaggataaatatccgcctaatattttttcctcatgcgagatatcataaggtattttaaattctctcatttttataactctcccttcattaaaattatggaactcagtatgatgtgtactgaattccataataattaatctacatttgtgctatgttaacaaatacacctgctataataaatgcagaacctaatattaaagcacctatagcaatccatagaatacttcttaatgcctctgaacgagcatttggattatagtgtgtagaaataattctgattgcagataatactatacacaaaaatattagtgcggaacctattgggaaagaaattgcttttatagcttgaacaactctatttccaacctctgaagcttgtgtaccattaacaacggatccaccttgagcaggagcagccaaaactggactacatagtatatttgttaataatattgttaaaaatgcgttagtagttattttaacattactaaatttcttcataattttattcatcatagtaccatacctccggacattattttttaataatacagtttagtgaaataatgtagcagaactttgtattatggctaatattagaaaaatgattaatactaaatattgggcaaatacaagagttgttgctttattgttttttataggatttagcattttataaagacctcctataaatacagttaccctctcagcgtttgtgttgcatgatatataagtcccaagattaagggacttgctatataaagaatgaatcctagaatagctccaccaataccacctgcccctacttttctcaagtttttggattgaacaacagttcctattaaaaaaactataatagagataatgaatgctagcattattaaaggtactatcattccaccaaaagcttgtgtgaaagaatctattgctgaaccacttcgttgaccgaattcagcaggagaaacaggtgatacactagatgcattgggtaactgagtattaacagttaatagagtgttagttaaaatattcatttttatcacctcaattagttattattgcgtttttttatttgaggcgaagtttttaaaaaatatttttaaaatcttctatttttatattgttttttttgaaatgacactctattttagataaagcttttccttttatttttcttgtattttcatatccaatattaagccgctttgaaagttctcttaatgtccgcttttttttattaaataaaccaaaataatgtactataatgaataattcagttttatctaaaatctttaatgctgatattatttgacgtgtattaaatcttttctgctctttttccataaacatttcttccgatgatatttcttgctctatgcttgaattgtctaaataagattgatattcatgagtatctattagcctcacattatgttgtgagaaaattttattatatatattgtaattaaatttataattacctttattaagaatatttgctttgaactttttacttaatttaattcttttatttacttccctggaagataatttaatcatattgttattaacgcgaatgctatttaatatataatttcgcatacaatgagtagcgtaagtagataatgcatttcctttattaatatcaaatttttctaaagcctttaaaaatcctaatttagcatcaatcaataaatcgtcaaattccatgccttgtacatttaggattttaaaatatttgttagtccattgaactattagtccctcatatctttttaataattcttctttatatttttcagattctttattgtttttttgcgatcctattattaagtctctctctggtagatctgctaatataatcttctttgatcttttaatttctgagttttgtaccatttatgggtggtattatctcccaagcatgtaataataacaagagagcattttttctcaataaccaatatagttatcccatcatattgaataacttttttccacgaattttcttcattaatcatttttttcttagtaattaattgaccatttaatgcaatatcaattaaatcttcttcaattttagtgatattaactttttcaccatcgcttaatattctactgatataacgatttatagcatgtttcgttactatgatattaagcataaaatgatgtacctccaatcaataaatttgcattgtgcttgcataatatttatatatacaaattaaaaaatttttatttaaaaataaaagagccttcaccatataatgatgaaggctgcttattaagcaattcttttattatttaatttctcttttttaaacatttcaattactttttctatttctgatgttggatctttatctttaaatcctctaatttgacgaatacaattatcttttacttctatagtgtaaaaagatttatgaggatcatcttttttccttaaaaatagaatattagtttccccattagccatttttcttttataagttcctccaacacaatgatgtaattcttgaccttcttttattaattcatttgcactagaagctacaagaattatataatctttatatttccaattatataacttagaaagttctttatatctttcataaatttttttattatatatctccatattgtgtttatcaaattcaagacaaatttcatcatgtctttcttttaatttttttggaaataaaataaattcattagataaattatatttcaattgaatacatttatctaaataatctttccatgttattattatatttgatatgggattatctaatattgtcttttgtttttctagatatttgatagttttatgaattgatgaatatttactaatggcaaaaaaatcacctgaataattgtatcctatattagatacaaatttaaattcttcatttgttattttaattttatttttataggcgctctgtaaaatgcttaattcttctccagtgatatttaatttttgcgatctagataagtaatttttatctaattttaatatttccataaagttcttacctgataaatcaaatagattttttacctggtaatcactgttgtacaaaataaaatctattaaattacttaatcctaatttccacaaatactctataaatggatatttcttagaacagtaaagataactatatacaggaaatttaaatccttgtttttgagttgcataagattttagttgagaatattgatattttgtatttttaagtactttatctaaattgcgagtgtataatgctatattccaaaaatcatattgatgtgcataaagaccagaacgaattcctttgcaccatctattttcatttgtaggtacaaaatttctatattcaaattcttttacagaatacccgtcattaaagtcccttagacattcgaatatagataatgtaggctctttataattagcaccgtaagtttttagaacttcaaaatatctaattacaagattagattgattggctttttgaattaaacaacaaacagcctcatcttgtaagcaaccaactttcccttctgacttaaagattatagaacttttacagcaaggacaaattccttttttattatgtttaggattagttatactaacctcttgcttgcaatgagaacaatatcctttaattgctttagtagttcttttatatttatagaatatatatctactatctattaaagctgtttcatctacccatttataaaaggtttttggtatttggggaacagttttcatataggaatcaatatattctaattcagtagagtatcttttaatgcgcttttcatttaatagatcatgctggaatttataaacatgatataagggcgtatcgttaacgtttaaatactttaggatacaattaatagattctgtatttattaataatgattcttctatccatctataagatataatgttttttattattcccgtactccattttgtttgtttattatcttcaaagaataaagtagcatattctctactttgtttatttaaaaatactctgtattttatctctagactttctcttaaaaagaaagaaagaattaatattttttctttatgagaatttataataatttttgatgatattaaatattttatatcacattctatattatctatataaagatctctttttatattttctattgttacattttttaattctgcttttctcattttcttgttcctcctaattttagtttatagccatataaagttaaaattataaatcaaataaagatacttgtagaggacctgcctttggagaagggatctgttctacatgttcttttatatcatctatttttatttctacgtcatcactatctgctttcacttttgttttattactagaagttaaagcatctataagattaatttgattatttttctttttaagtgtattattttttccctgtttaattatttctttttttctttcctccattttttttgttctttcttccatagcttttttagcagcagcatgatctattttataataatcccaaatcagttgatgaaattcttctacaggaaggtcccattccatttgaccatatttatttctagcttgcgatataatatactgtactgctccttttaatgtagcatcctcgttagcgattaaatcagctaattcttcacaaataagctgatttatatgatatatagtagcttcagtaaatataattgctccagacatagtatatatttgcataggttccatttttactatttctcttttaaattcttcatgttctctttttatttttccttcagcattttttaaattttcattcattttaaactcctcctaatttaaagttttagttctcaaaccgtgattttaaatttaaataattattattgctttttttaaaaataaataaaaaagcaatgctatttatatttttaaaatagcattgcttttaaaagattaagcactaataatagataatggctggtcctttttaacgattaattggaataattgacaattaggtctattaaaatgtgtaatactttctgcattgtcaatgagcattggcaaatttaaatcagaaataattgataacatgtttctgatttctatacttgttcttattctggtagaattagataacatatttaaatgtttatcttcatagtgtatttcaaaaacatctttaacttctccagaagtcttgctaattttttcaaaaattatttctgttttattaagatgtttttgtatataattactttgtaatttaaccctagctgaaatgaatcttttaataatatctatagttaatttcaatgaagatattctattattagtatcttctttttttctttttaaccttgcaattttatttttattttctgttactaatttttcttttgtacttatttggttgttatattgttgtatttgatttaactctgattctaatttagctaaatcattttttaatttaattattttattttgattttcttgtttaaattttattattttctctttttctgttttctgttttgctaagattttattatttaatattgagatttgatttcttagttgagctaatttattatttttattatcttgaaatgctttttctttttttattgcaatttgttgcaagtgacctatctggctagatatttgtttgccttcattttctttaagttttctatattcatttacttcttgaatatattttttcttttgtttttcgttattattaattgcttcttctaactggtgattagctgttagtccgttatttttaattgtttccaaagagttcaataattcatttagtatttgttcatttgtggataaaaataaaaatccgcatttaggacattgagttttatttttattaatcttattaattttatttcccaattccttatattgattctttaaattaataacattattttgtaaaacatttatattttctaacattggcttttcgataggaacatttttatattcattacgaatatttctatattcgttagttaatttatttagtttctcttgatctgtatcaataaatttttctgcctctgttcttgctatttctatttctaatttcttttttccctttacatcttcgtcttcatttatatttgtgtcagtatgaagattctcagataaaatactttctatagcggattttaatttaataatttgattttttaatttagtttcatcttttaacttattctcagtaggattattgatacttgataaattaatactgtctatcattccatctgtatatattaaatctttctccaattcactaatatcatctcttttttctgctaaagaaatattcggattattaaaattaaatttttctttagttaatatctcaatttcataatctgaaaattctttcataatttcagatttaggaattttttttaaatatttattgagaaattctttacttttcttaggagtaaataaaaaaaagtagtttggattaagtagacataagaataaatctttatcacagttaaattgttctgccaataatttttcagttgtagttttagtaccatctacaaacaaaccattatcattagcatatccacttcttctgattaattcatactccttatcatctatactatagtttatttttactatagtatattttgaagaaagattttttaaatgagatatacttctttctacaccatttaaatcgctatttaaaaatccccatgctattgcatcaccaatagtacttttaccttcttcattttctccccaaatttcattatttcttttaaattcataaacagcttcttgtttatgtttactaaatcctttcatacttaagcttttaataaataattccattttaaaattccccctattatatattttgattagaaaatcttaaaagctttattgctctatttaatatcttcggatcacctaaagatttaaaatcataccctgtggcactagaatattttttaaaatcttctttatatatacaattttctagtaaatcaggatacatattctgaagattctctagttctctagcccattcattataggtatagtcatctattaaattgtcatttaacctatagtaaatgcagctatggactaagatctgtcttcttcttttatttattagttcaattatttcattttcgtgagtgttatttttattgacttgcttttcttcagttatatttttagatgtatcaagcaaatcaaataagttactttgctgaaacatataaaccctccttaaattacatctagcatatatactcatatactaaatttttaaaattttagctttaagccattgatagtacttaaataattattatttcaaaaaaataaatatagctaagaaaatcttagctatattacagtaattattgtttcttcatatagttctgaagttatttctgaacttgaattacaatatttaaattttattatttctttattgctatctaattgcagttgaaaattaactaaattatcattttgggatttagaagtaaatattctacttttgccttctgcaattaattttaaaatatctaattctgtaatttccgtattacaaatagattttttaatattaaataaacatccattcttattattactacaagtataattgtttttttctttaattatatattggccacaaaatggacatctacaaataatattctttttaatattttcttctttccttttaatattttcctttatttcttctattaaaatgtttgcaattattaataaaactacaccaataattaattttgtcactgttgttccccctatatattatttttttaaatttttaagtaatatatttattattgcttcacaatctttgtcattattatctaaagcccatgcagtattcattgctactaaggcttttttattatggtttagctgtatatgacaaaatcctttattaaaaaatgccttgctatattttggatctattttagttgcttctgttaaatattttaaagctttaccaaatcttttaagttttatatagcaaactccaatattatataatgaaagttttatatattcagtatctttcatatctttcatatctgatattgaatct

SEQ ID NO: 2 - DNA, 270022 bp, Clostridium botulinum
aactagcaccactccttcagaagttgtaacagctttcttttgtttgtcagttagttttatttgttttgtttgtattaattcgaaaaaatctcgatctgtcatctttccattttccctttcttcttgatatatttaataagttcttcccctggttgtacatttctatttaaatctaagttaatcttttctttagcctttaacttatcgtatttttctttctttaatactgttgtataattgaatgatattttaaataattttactatttttactgtttgtgttattataatttttttattaaataaatacaattcattgaatacaataattagcacattgctaattttctttgcatatttaattgtacaatctaaacatttaataatgaaattaatgtatatatctggcatagtatcgcccctttcaacataataagcagagaacataatcactatattctctgcttaaaaacccgttcactttaaacttctctttaattaatttgttattcctcaatattagccatatattttgaaacattactatacttctaataataattcgtaacatcaaaaagtacactttaaatcaaatatattacatcctcaaaatttgaataagataaatctatctatatataattattatacatttattaaaaaatttattaaaaaatacaaaaaaagtttcaaaaattagtacgataatatttatatgagataataaatatatgtaaagttaatatggcaaattgctaaaaccccctaaatcccccttttcaaaataaaaagtttaaaagaaattttaaactttttatttttttatattcaatatttcttatatctaatatctccattagtggttccattactattaatcttccataagccttttttagcacttctagcttctctttcacaatttgtaaatgtatcaacgtattttacatttggagggaatgtactttgttgaccaaatccatttgataataacatagaattaaacattttagaatttatttcttgatcactattgctttcaggtatctctagccaaacatatcttagcaatctgccatatttatcagtattacttatgtctttttctaaatatacagttttatcttctaacatagatcttgtatataaagtagcttctcttccaaagtcctcatgcttagtagtgtcttcaggacagttaaccccaatgaatctaaccctttccccagtatttaaaattatagtgtctccatctataactctatatacagttgctttttttaaacttagattattttttccaggataattattacctttaatattatttattatggaaacattatccctcacaacatcttggcttaatttagtagcttcattaatattttgacagcctgtaagcaaaacagttattaaaataataggaataaattttttgatccccataaaattatcacctcttttatcagaacattttaataaaatggcctaatgcacttaaatatatttctttagctacagtttatttcaatcatagttttagttgttgaattcaaaacttttcccttgatttatattttaaacaaggaaatcattttaatttaaaacgataaagtattttacaatttattccctaatatattatcaataagtagacgatattgatcattcttttggtttaacaatttttctacagaatctccatttatccaaatatattttatataattgctatcatcaataatctcaataacatattccccttttacgaatatggatttacaattctcttttaattttactatgttataatattgctttcttttcttcgaaaaatcatcttttaatattatttctcttttaggttcacaatcatttgctttatttataagtatacttttatcttcaataatattaatcatctttaaaatctcctttataacattatttaattaattattatttcattatttaaaaatagtacagttctacaggaatggctataagcgttgatttaactagcattgcgctatatccaaatctaaaggacaagtttcgcgaaatcagcatttcgcgaacttatctaaaaaattaagataatagtatatattttgatcaaattttaataaaatattgtttctatataaatagcgattcttcataaaaaaattatccccttccaaatttaattatggaaggggaatactttttttattttctttgattatgttttaataatttatcatagtagcttataaatttaataggtgtatttatacttttgtctatactataaatattcctttttttaaatttttcaattatatcatcctttctctataaagacctttgtcgctttttataatatcttgaaattttaggtcatttggtaaaacttgttccattaattctttatatttaggactatatcaactctttctttcttcatataaatcaatttgcactatttttaaagaattgttttgaaaataagatgtattaattatttttcattcataatctggtacatatgtttatggtagccattccttatattgctcttttatatcttcaacattataaagtttttttagagcttctactatattttcttcatgaacacatatttattcatctattaatacattattttctataaatataacacatgtcataaataatatttttggatgaaaattttagtcatattggtttactttcagaatataataaagcattaattataaaaaagtaaagttatacttatggaaaatttatttgtaaaaattaagacattaaaaaattatactaaagaatttgaagtaattattatcatttcaaaaatactgtaaatatatttattcaaaactataatttgcaaaatcattataatgatatcttgtatcatttatgagatataccactaaacttgtatttacaataaaaatagtattttttcttactgtaataatattgaataaattaaaataactagatattagcatagcaatactcatatctagctattcttaaacatattaattttaaaatttttatggatgtttacacaaaattcttgacagactcatgtagtttgagattaattacagtggcctttctctccatccatcatctacaggaataaattcccatgagcaacccaaagtcctactagatctttctatttgtctattataccaattacttgctactagtttagctatattattaaactgatgaaatcctataaagcctatatcattcccattattatcttgtaaattcattttgcatttatttgttattccttgatcattttttgacttcattactactacttgacttagatttcctacatcaggtatttctaatgcacttagtattttttctacgcctgcctgtgatgcattagtagctaacctatattctttatttttaactactacattaatatatacacgatcattatttctaacaatattatctttatttccagaagcatatttttttataataaattttgtccccatatacaaacttgaatttaaataaatgtttgtagtcattacgttatctctaggccctttaagatacatataacctctaatacctacattatttacatcgacatatttatttggatcatataaatttaacatatagtatgatttatcatattgtaaataatcaccccaaaagtcttttaaaatacctgaatttgattgattatcatataaatctttgatctctttttcacttaattctttatcgaaaagattgaaatattttatcacgatgtatctatgtggatctctacagccatctaatttaaacattatcttattactagcatgaatattacctaaatttgaaattggtttttgatctattaatcttccatttatataaattttagatttagttattctattattagtgatagttacaaaaatccatctgtttatataatctgatatattaatcatttgactgtatttaaaaactactctttgttttatttcctgagtatcctgtaaagtccagattatttcaccataattaagtgatactttccatcctgaattattttccatacaatttattattgtatattcattatttagacttatactgttaaaatacttaggaattcttatccaaaagctagtactaaaattttcatacatactattatatacaatagccttttttaaaattacctcaattgtactactttctaaattaattaatcgaatttgatttttatctattgaattataatatactttatcaccattatatatttctgctccatacctagataaatctattaaatcatcatctttatatactatgctcaatatagaggcattagtaatattcttaatatattcagtaaatgtagataataattttttattatctacgtatttagaaagctgaaaaggtatatctgcactaagtgtattattaactttatcttttaatctatttacttgaccaattaaagttcctctattatcatatatatactttaataatacgtctctaacactagcatcaaaatcttttaaccgtttaacagcataaggtatcatagaattcattaaatatgaaacagagcattgatccaaaaatttatttatgttaatcatagcgctatttatagactcattaagtttcgaacttaaatcatcaatattaaaattaatattatttttctcttcctcagtatattgattatactgatagtttattatagccttcgttgcttctgcctgattttctaaagcttttttcattttttctcttattagattgatctgtgtattaactattgccaaccaatttgttactatatatttatagacctcatcccatttttcatttcttttacttaaagcattatctattgtttgaacggttagaaccttattcgaaacatatgatacaagtgcaaaagtacctaatacaggtagcgcaatctctggtacaatttctaatagaataacagctcccgaaaatattatagcttctacaaactctcctttatatatcatattacctatatttaaagcaggtcctatatatggaataactatagttatatcagcaattttatccatagtacttacctcattagtttcatcagtaaaatcatacactaagttttctatccaattaacaaacgtaactgcctctacagctttattaattgcttttatatattttgaagaaaaaaatgtataaacaatattaggctttaataaggcctctttggcagaatttgttaaaataatcctagaattactatgtttgaattcttgagcacgaaggtaatggaacatagtatatttatttaactcatacttttttccattgggaaatctttctatattaggcataggttctaattgtcctataatatcacttgaaagattttctattgaagtattttcaggttcattatcaaaattaaagtttaaataatattgttgtattaaatctaaactaatattttcttctgctgcttctatattagtatcagatgtaatttcttctaccttatctagatcattagtaaaattatcttctgaaggactaaaaaacagatcccaattattaactttaatacataactcatttaatgccttattatatccctcatctaatgatttagttttagaagttattatccctcttacacatagcaatttataaaattcaaacaatccagtaaaattttttagtttgtcaaaattcttattattaatttctatattttgaccgttaaagtttgctgctaaatttgtatttcttaaattaaatccatcatgtattgtgtaatttacatcaggtactatatttatcttaaatacggctttatcaaaattcaaatatgtttttctgttaagtactttaaaaaacttaacaaaattatcctctgtgtaaatctctgttaacagtttgtataactcatcaaattttaatctatctaccaaaaattttccagttgcatcctcagataggagatatttctctttaaaaacatttttcatatactgtaatgaagcagtagtacctactattgatttagctttattaagtgtacttgctatatctttaaacttattataataatatagactaaattcttttttctgtaaactatctataaactttgcatcatttcccccaaatgttataagttcctcaagacttacttctaacccagccatttcataataggcattagtatttactttaaaaaccctatttgtattaattgctattccatataatctatgttcagcatgtataagttcatgtgctaatgctactgctggatcctgagcaaatttgcctgcacctaaaagaggatttgtatcaacttcaagtgactcctcaaaaccaactgtaaaatccgggctaaatctaatgtattgagtagaaccataaccatttcgcgtaagatttaaaacgtcgtctctaaaactactacattgagactctataatattagctgagggtcctattattgctagattaagttcttctgatctataactatcatctagttgtattatattaatacaattagtatcaataacttttaattctgtatctattttacctccaccccaaaatggtattccccttactattgatattaataacattcttccaagatcagtcgaataaattctctcaaataattttataactccctttaaataattatctttttcattatctgtacttaaatatgctgaatcataatatgaaattggaacttgttttgcttctggtggtggatttagatctacttcttcagggtttgtaaaaatatctctttctggaataacccatactttattatgaattttaaaagcttttactggttgcatttttcctgcattcggaatttttatataagcaatatcaacaccgttttcaggatcattataattaaattgtttattaacaaatggcatatctaacacctcttataatatttaaaattaattaaattattaattatttaaatgaccataaatacaaatactttgatgcatcattattacatatcatccaattataggtttcatctttcatagataaacatatatatttaccgttataagatagagttaaacaattggaaataaatatatcattactaataagcattttctttgcactatttttgttatctattagttgcaatctattatctgcagatatatctatatatttttccatattatctaatacagaaattattacctcatcaagtttttgaacatattgtttatttggattgatacttaataatttaaatttagaagcttgtaaatttaaattgtttgtattattaattgttaaatatatattattattttgtttaacttcatatatagggttgtctggaaatacataattatataattgatatgtcttattgtattctaatcgttcttcattactgtcccttatatatgaattatttaaatccttaaaataattgctcagaacttcttcacctgtagtaggtttatttaaaatagttaatccctcaatataacttgcattattattacttaataaagaaattatattacttgaataaatattcaaaatttctttgatactttcattaactactaaattatcatcaataaatattaataattgttcttttaagcgatctacagatatagttatatagtgccaactattattagaaacatcagatagatatatatttttatcatctccattagaatctatcatattaaaaactagcccagtatcttgaaaataaatttcccaaccacaattatcttctttactacctattaacttagatttagtggtatcttggcctaaatttctcaaccaaaaataaattgaaaaactattagttaatccattttcaaagaaatcattagaaaaacttatactttgatcagatccatttaaatataatgcatcactatttattccataaactaagcctatgtccttagaatgctctactgatgtatctttaccagatgcatctccgataacattattacctggttccttaaaagcatataacactagttcataaggcgaagtttcttcctttataagtaatgctgtctctgaactaaataaacttttcaaatcttcaatgtttaaaaaatcaaaatctaagatactaaaaatattttggctaatcaattgtaatttttcattttcaataatattagtacatttttgtataaattctcttgtattcttatttatattattaatacattgttccataaaagaaataaacttaggatatatattactttcaaaaacacatatagcggcactatttaaaaaactatctacattattcattgctatttgtgattcgtttgaaatatctcttaatgtatttgttgttgtcagattcatcaatgctaagttatcagatgatatattagaatttcctattaaataactcaattttttttgtattattttttttattaaactttcttgagctaatactgatcttttagccatacaaattaaatcaaaatattgactataatattgtgtccaccattgatctaagaaatcatagtagattttttcaaaataagagttgtttttagagaatatattaaataaattttcacttaaatctttaaatgaaagattcaacatactattaggtatttcatcgatttctattttaggcatagttatattttcttttttattaataagagaaattggtcctaaggttttaaattcttctatgaaagaattacctgtgtttaaaatatttaaagctttacctagccatggtactactttattaattccacatggaatattaacttcttgggtttctgtcatatcaaaagagtaatttctaaaaatctcttttaaccataaataatattttttatctgtatcaataggttcatcatattttatagaatctaaataatctattgtattgtctaaaaatgaatatactaaagatctatcttttgaagaaattaccttcgaaaaatctgatgataagttaatatcattgctatttgtcacttgggcctgtaaataatttactgaaaacggagtagtagtattaatttccttggtttccgtaatattatatacaggtataaaagggtcagaattttttctataaggatatatatctgcatcattgataggaggaatattatttatttcttcgacatttacattatttaaataagaataattaatatgatattcatcacctatgttatagggaattttataaacagcataaaaattgttcatagtaccttttaagccatccccgtaaacattacttttcattaatacactattattttcatttattaagttaattattaattctggcttatttataatatttttattatattttgataaaggtaatattgttttaatttgaccatttataaaaccatttatattgtaatttttaaaataatctattacataatattcttttctatgataatgattaagggcattattaaatatttctggcatcataatttcaaattctgtagaaaaataacttaaatttaattcccatatatcttgtacattagtcttaaatttttgttctaaatataatttaatgctattagcaatatcattattatttttaatttttgtttcgtaatcatttttatatttttcaaagtttttcggagcatcactaaaataattatctgtaatccaataaggattagtatttaaaagtttatagtcagttccgcctgatattaaaaaatcaacgatatttaactgtgaatattccgaattattaagttcacttcttaatctatatggaatacttaaatcatcactaggttttattccatataaataataaagagattttatcaagcattttattaactctaaagcaggatcaacataaaattgatcatatttgtatgttaaaaatggttgaaaccatatttctgacatagttcccatgccattttctgcatattcttttttataataaacaacattgttttttattatatttgatcctggtccaaaaataactaagttagctgtataataatgttcattatacttagaagtaagatagttagtttgtctataatctccaggtttatattcataagggaaagaaatagctgtggaaattaaagataataactttgcacctataacattattatttattctttgtaatatcttaacagttgcttgtaaaaattcatctttttcattatctgttgaaaggaaactagaatcataaattcctccatcagatttttgatcttcatttatatttaatgactctccataatatctttctggggcaatccaaatattaggagccacttgaaatactttaaataaagcatctgtttttctccccctaacgattgctacatctctattatctactagagaattaatattaaaattattatttatcttcatatattctcaccttctttaatttgcttttccttgtatacaaaatccaacattaaaaataacatttgtaacctctgaaatttttaaattattccaatttacaatatcatttattatatttgtaaaattatttgctaattggaatcctaatgcttctttgatactttccatagaccaatatactactgaatttattatagctgcaggtataagatcaacaggacgtatataaatttttttatctgttttagcgtttttatcaatttcaaaatacgccctcttattcttagaatcatacataaacttattaatactacttatagaaaaatcagcatatacaatttcatatcctgtaagttttactcttccggacacttttatatttaatttatttccttcatatgaattcaagacaaaactgtttattttagggtaataccaaataagtcctaccttaattccataccagtttaaggtactgctattgtaaatacctgctgtagtatctgaataacttgaaacttcaaaatttttttgactaatatcagatcccatattacttgaaagtttaggtaaagctaagttttggaaaaataatttttctgatataagtaatcctacttcactgttattagataaaatatttccatccacattagtacttaatttagaaatatctctatttgttactactgataaaataaataagtaaccatcactattattagttggagaataatacacaaatttaaattgtttgggattcatccatgctatattagaagtaacatttaaactagcaaatatataagaaacttgtttttcattttggataaaagtatctattagcaatttattaaaataaaattggtcttcctcatctaattttccactaaggtctgaaactatgaccttaatattatcactagattcagatccaaaatcaaatttaagtttcttaacattaggatttgaagtatcattaaagaaatctagtttaatttctaaaactggattaataccacttaggtcaatagtagtattcctaactttaaaatatcctttcttaattaaaatcttaattcttaaaaaatttgatgttcccccattaataatttcccaactttgaaagttcatttttatttcttgttttttagctgtattagaatatagaaactcaactttattcttagtaatatactcttctaaatgtttatttacaactcttttactacagccatagacaatatcccaaccataagtattcatataaattcgccccttttattttaagttacataaatatataacttatccaaatcaatttttgtaaacttattaatttactttttaagtatattaacaaatattatccaatattaataaagtatttgatactgcataatatttgtttagtttactttttaagtatataatataaaattataccagagactgaatggagtgaaaacaatggaaaatttattctttataataaaaatattaaaagatgataataaaaaatttgaagacatttatacgaattataaaaatcttatagatatatttattaaaaaatataacttatctgagaattacaatgatatactaaatcatttttggattattctaaaaaaagctgatttaaataaatttaacactgaaaatgatttaaataaatatattagtaaatgtttaaaaagatattgtttatctatttgtacgaaaaagaatagagacaaaaaaattatatacaattcagaaattacagatataaatttaaatttaatacaagataattgctttaatgatatagaatttgaatttaaagatttaatatctatattacctaataatcaaaaaaatattatatatatgaaattttttaaagatatgaaagatattgaaatagctaaaaagctcaagataagccgtcaatctgtatataaaaataaaaatttagcattagaaaaactaaagcctatattaaaagaacttattaatatatagtttatattttaggtttacaaaaaataatatagagatgttaatatatatacacggttgtgttaagtaattatgaaaaaataactttaaaaatcacacaattactattatgttcgttttagaggttaacagatagcaaatttatatttttaaggcacaataaaaattctatccataatgtgattttaaaaataaatagattcaaacaaagggatagcgtatgccattagacaattaacaatcaattctttttagctttagatggataaataatttcaattacccctgtagacgataaatcatgtcatgaatagtgttaatgtagaaagttataatgaaatataaatatagctatcagtttgttagcaccatcaaaggaattaaaacccttaagccttcataccaggatttaaatattttattaaaatattgattctattggtacattataagaaaggggcttgttagtaactatagctctaggagaaccaaatttcttagtatgattgaataagctaaaagcttgctatgtatctctatatgatgataaattataagaaataataagacgacttccagggtcaattacaagccatagataatgatgtttactatctataaatataatagtttcatctttatgccattcatcataatctgataaactaatcccttttagtagtagcattagattttaatcggaaataggtagcaaattttttagttcaatttgcaatagttacatgagatacttttacgttaaacaatctaaataaatattgagaaatccttcttgtagaactttaattgaggaaataaaaatccaatgtcattaaaataatatggagtgggaatctcataccttcaaaatctaatttgacatatatagtattattacttgaaggcggttatagccataggcttcgctacaaagagaatatgattaaactttttatcgttacaacaataattaatgtaatttgagtaattgtgatgaataaatgttcctttgccacaaaggacaaagatgataacaaataagctgatacttctgctccgcaggtgcgagttatttcttgcactctttacattgatatttctggcttatatctttgctttaccaaatttgtagatattattactatgacatttaggacaataaattttactagttttattcattgatgtttctctcctttctgagaggtaatgattttatggtgaaactattatattccaataggccaagagaaatcaatattcatataacttaacagaactaaacaatactaaacaataaaaaaggaggtataatatgaagcaaacattttcttttaattttgatgacactttatcaaattctaatggattaattcatttagaaaaggtaaatcaaaattgtagtcctaattatcaatacttcaagattaagtttattgaaggttaccttcatataaaaaataaatctggagatatcttagaaaaatatgacttaaaagatttaatatccttaatagctttaaaaaaagattatttaaaactatctttctcaagtaataaaaatttaaacgaatttacaaatataaaaaagaagcctctagaaaatagatttaacttatatatcattaatgaagatattaataaaaagataagcaaaaatggaattttagaagaagtaatattaaatagactattattgtctattttattaggaaatgaagaaaatttattacaagtatcataaaggaggaatatttatgaataacttaaaaccatttatattttacgattggaaaaaaacaacctcaaaaaatgcaaaagaaaactactctataaatgaaattatacctaaaactttttttatggaacttaatggaaccaaaatcactaattccacactaaatggtacttggaaatcttggaacctaacaaatgaaggtgaaggatcttatccagtcttaaaatgtataattgatgatggatacttagatatgaattttggaacttcttctgaaaaaattcctttaaaaaacgtttggataaaactttgtatgaaaatcaatcctaactcagatggcacttattcaatacctgaaaagagttcatcattctatattaaagataattccttaaaaatttcaaaagataatttaattttagataaatatttaaataaattaatgctttcatattttaaaaataatataaaaaatattgaaatgtttattaataaatctagaattcaaactaaagtagtaggagatttaagcttattaggatggaatactgagaattcagtatcatttaggactatgaatgaatttattaaaaaagataatctgtacccaaaagatttcaaagcagtatatagttataaaaaattgacatttacagcaacaggaacatttgatagttgggaaatgaccacaggtgcagatggacgaaatatcagattcaaatgtccgattaaatctgcagtctatgatattgatggtgatgtatttaattcatctacagaaaatttcttgttaattcaagtagatctaacatattttgactctaaaacaactattaatgatcctactggagaaaatgacggaaaacaattcaatctaaaaataaaaacaaatgatgataaacttaaaaatgttttaatagttacttacaatctaactgatactgatggttcaatgatttcagaagataaagattttttaagtttagcttttagaaattggtttaatgaaaatatacaacaatttgaacagatattttcatatatacttttagatgaaactgctaagattccagaatatcaatggttaaagcctactcaaatatcttatggatcagcaagtgtagaaactgctaatgatgaacctgacttagatgcaagcattttttcagcaatgtccatggtagaaaataatactaattctactccaagctatgcggtagataatagaatgttacaattaacaaaaactcaagcagcttttggtattagttttcctatatttatggaacattttttaaaacaaggtatgttaaacactcaattgctttctagtaatgagattgaagttgtacaagatcaattgcttattactaataataaaagaataaattttggaaaggttaaaaatgatagtggaaaagaagttgattcattgcttgacgctgggcaacttaaattatcactccaaaataatttaattgttttagaattatttgatttaacttgggaacaattaaatggtgtaacagctcattataattatcatcaagaatatgaattagtattaaaagccaaagaatctggagaactaattccatttcttaaagaattcgatgaacctatactatcatattatgtagaagaagctgaatggaggaaatacactgatatgctagtatcagctttattaggtactgctttctctatagtactaggtggagttctaacatttggaccttctgtagcatctaaaggcataaaatttttaaaatccaaagcaaaaacagttggaaatagaagaacagttagcctcaatagaagggacatggcacaattaagaagaggttcaggagcatcttcagaagagattgaattgtttagtcgaggaaatagtgctgaagcagctcgccaaattgatggcatgttaagtaatggaactactagtgcaagtactataacagaaataagaaatacatcaatgtcaacaggtcaaaggcttgcaatagtaggtaaaaagtttaagtccacagctattatgcttacttcaatgggtttaggaatgacttttggtgaaatgtttaaggaatatataaatgatatacaacaaaataactatgaggctatcccaggaattaataaatttatgcagcaatgtgttggcgctatgaagtggcctgataaagacagtgaacttaatgtgacctttagtaaacttcaaggaatttatttattaggtggaacattagaaaaaaacaataaacttaacagcaaataaagtataaaaatatttgatctaaggaggaactgaaaccaatgcaaacaacaactttaaattgggataccgtatatgcagttccaatagatattgttaatgaagccattaaaattaaacatcctacacctgaacaatttgaactttctgatggtaaatatggaaattgtaaaggtagtttcgaagaatggcaaattataaacggcggagatggaggtaatattaggcttaaaattccaattaaaaattttaaagctaatgttataggcaaatatctaattggtacaggaggctttgaatctgcaaatttagaaattcaagtaaaacttaaatatttaccccactttcctcaaagtaaaaataaaaatcaagaattggtagatttaaaaataagaacaaaatcaaataacgcagaagatccagctattataattattccaacaagcgaagatgttaaaggattttattttaacgaagatgttagaagtttattaatgactgaagatgatcagtttattatgaattattttcatagattaattaaagaatggttagaaagaaatttatactttttcaactacgtttttaatacagttaatttaaatttatatatatctaataatgaaaaatggaaatggactaaaccaagttatgtagattatgcttattcagaaatagatgaagatttatctaaaagtatcttaggagtattatgtatgactgatggtagaaaaggatcaaaaaatcaacagcaaaagattgatcctaatgctattcccaaaacctctcaatcaggttttctaatttctgaagacagattattaaaaaatatattactcccaactataccaaaaaaattccctaaaagtaatggagatgaattcgaagtagttaatcaaagtgtacaaggaggaacatatagctatatattaaaattaaaagaaggtaagaaaattaatttagataacataaacgcttgtggttatacttgtacaccttacatccaagagatgaaagtatctttattaggaaattatctaagacttgagtctactacaagagttgatctgccactaggagtttcttcaatttgtgaaactatgtgcgaatatagatttaaattagataaaaatgacaagggggagcaaactatagcatatgaacaaattggctctccaactaataaacaatatactgaaaaaacacaggatgtaagctttgaaattataaaagggcttttaattgcaacattaggttttgtattagaattggtaccaggaattggatcatttttagcagttgctttaataggcggtacattagtaggaagtatatctcttattcctaattttattgaaagctataatgttaatacagctccaagtatagatttatcattagaaaattcagtttctgaaatcacatggaattctagtgatatctttaatcttaattatgtagctttagctggaccgcttcaattaggaggaactttacaagtacaaaatacttaattatattattattttaaatctccaattatcctttataatgatatatttaaaatatttcttaagcataaggttctataaccttatgctttttaattttctccttaaatcttaaggtatttttcgacattttaaagatttttcattttttatcttcttctaactttgtaaaaagattaattaaaataaagcttataaatggtttaaaattgtaaaattaattttatattttttaaataaagtttgttcaaaacttaaaagtatattgaacattaaatttaaaaataatattatatttcgtaatattattaaataatagaagcacttcattgtttgaattaatgtacctatgctaatatgaataaaaacacgaatgattaaactttattatatattttcattaaacttttttacaaatagtttaacttttttacaaagccatacttcttacatagattaatttttttatttattttatctttcttttttcattcctaaaaactctcccaccccacccttaaaaagcaatttttctatttatgtcgcatttgttattttaatttttataacttaactccatagcgttattactaatatacatagttttacaccttcaagtcctttttagggtacccgtcctaatcccagccacctttgtacctgccttgaaggtatgtgcagatacaaaggtggctaggtggacatgctcctagttgtagctcactattcgtgaacttataagggcataatttatgtgttatttgcttttctttttcttctataatcttatagatttcatctcctttggaagatattttcctattttcccaagcttcgtttcttaattttataatttcttttttaatatttctatttgatccatttttaaaatttcctcccaaacttctaatgcctgttcttctgtcatcacttcacctttagaacttccacaagcctgtgggtacccatcaaattttataccctctatagttttccctttaaacacatattgtgttttcggactacaatatccatatcttgaatataataaaaataagctaaaacactacatcgatatacatagaaaattctatgtatatgaggctcattgattttgagttcctttctttattgaataagaaaattacaagataatatttatacttttcaaaataaaaagaggagttagctccaattaatgaactaccttctttttgatatctattttaaatttctaaataatgctttccatgtttcttttcctacaattccatctgctactaagtgacaatctctttgaaatgcttttattgccgttactgtaccgtcaccaaaaactccatctgctccataacttccaactggataccctatgtttataagcatctgttgtataacttttgttattccacctctcgcaccttgtttacaaattggtgcactattaatagttgcctgtcctgctattccatcaactacaacttctccaaatccttgggagtttatttcttgttggagttctcttattagataatgccctcctctagatgtgttattatttagctttgtattagacgctcctgccatgtttaaatagcagtagttcatatctacagctgcaccagctattcctggtactcttccattttcactatattgccatataccacactttctatttaagctattattataccaagcataccacaatgcatatctttttaataaactgctatcaaatttatttaataaaaaatcttgattagaataattcattgcaaaatatccgtttctttctacttcttggcaaaatgcatgaaccattttagtagctaaagattttgtaatagttactccgcagttattagcatatcttatagtgtcgtactcaagatcataacaaataggataacttattttatactttgttgcttgagctatacaatattgtgcttcttttcttgccatatcctctgtataagcataactaaaccaatatagtccaaatggcattcccacacttgtacatccatttgcattatttataaattgtttatctatattatttttaccataaccagctcttaaaatagcaaattgtattccactattttttacagccttccagtcaatttccccttggtgctctgatacatctattccctctaacatatacattcctcctaaatttttctcatagttttttaactatatagtaatgataataagaatccaacagcttagctggttgcatttctatcgttctataaggacattttaccagtattataccttaaggctcttttttattccgcctatatctcataaatgctactctaataggttctatttctctaatttctaatttatattccacattgcactaactcttattttctttttttatactcatccatatttctgcatatccactaactgttatttcatcatatactggatatacttcaacatctgcaatttctgtatatctatattccgaaaacggaagccattctgtaaagaaacgtttatagatagtttgtgtggattctttgaacggacctcgactctcaaacacagcccaaattgattcaggaatttcatattcatacattccttctggtattggtttatctgtagtagcagcaatataataataaacttcatcaccttcattataaattgatattccaaaaacttttttttgtggtgtattatttagattcagaatttcgtaaaacattccactttgttttatttgttcccaaaatgatgaaatcaatttataatttttatccatatcacatgttaatggaatacggacaccaacaattcttattggagcttttttttcaattctatatatcatcccatcacctccttgtatttgaattgagaatttaataggaatatatatgcacaaagttgacatccttgggattttgccatgtcaggattaatgtcatgtacgctttgaaattcacgattgaatgttgttagcgaaatatatccatatttcatggcaatatctaaaactttcatatcttttatctgtaattcaaaggcagcttctatcattcttctacgccttatatattctactaatgttatgccagtaacattagcaaaacatacgttgaaaataatttgttgaacaacaagcaatttagccgcttcttcatatgaaatatccatatttaaattttgttttatataataaatatctttactcaaattttttaactactccattattttaccatttccattatactaatgataattatatatttttttagatatttttttgtaaatgtatgttgttattatttgagatattttgtaacttttcttttgataagcaattatataaatatctttgtttaatatcattttttgatattggctttgctctataatacttattaagtatattttatttctatttccacaacaactaattcaaatttcacccaatttatggtataattctaattaatgtattttttaatatttttagtaggttgactggttgctaaagcaatagaagtaaaagttctgctttctcataataaattatagctcttcaaacaaactaaaaaattaaaatattaggaggtaaaaatgaaatttatattatttattttaattgcatttatggctattctattactattacttataatcggattactattacctaaagatagaatagcaaaaagagttgttactttttcctctgacataaagacagtttgggatgtagtaactaataatgaagattatgactggagaagcgatatatctaaaatagaaattctagataatggagattcttggattgaatacgctcttaatggtagccatataaactttgatattcttaaaaagaatgattgcaaagaatatgatttcaatatgaataacaaaatgtttactggaaagtttactagtaggtttgaaaaaaatgctacagaaaatgcaaaagttgaatttgttgaatctatatctataaaaaatcctatacttaaaccaatatcatatttattttttgatattcaagggtttcaagatacatatatatctgatttgaagaaaaagttaaatgaataattaaaaaagtagattaagggatgtaataaattctgtgtttatatagatttatctacatccctatataagctgtaattataacatatcacttatagcttcttttatttttttcactttatttaatctttcccatggcaaatctaaatctaatcttccaaagtgtccatatgctgctgtctgcttatatattggatttctaagttctaattcattaataatagataatggagttaatttaaacactttatttactaattttataataaattcatcagaatactttcctgtactaaatgtatcaatactaatagatactggattagagactcctattgcatatgctatttgtatttctattttatccgctaccccagctgcaactaagttcttagcaacccatctagctgcatatgcccctgatctatcagcctttgtaggatcttttcctgaaaaagctcctccgccatgttttcctacaccaccataagtatctactattatttttcttcccgttagtccagaatcaccttgtggacctccaactacaaatcttcctgttggattaattaaaatctttgtatcattgtctataaatttttttgggatagttttttctatgacataatcaattatatcctgttgtattttttcattagaaacattatctgtatgttgtgtagaaacaactatgcaatcaactcttttgggaacatctccatcatactcaactgtaacttgtgtttttccatctggtcctaaataagttaattcattatttttcctgacgtaagctaatcttcctgctaacttatgagctaaaactataggtaaaggcatatattcaggcgtttcattatcagcaaaaccaaaaaccattccttgatctccagcacctatttcttttactttatcaactcccattgcaatatctggagattgtttgtctatactagtgattaccgcacaattcttacaatcaaatccgaattttccatctctatatccaatatcacttattgtctttctaactatttcagaaatatctacatggcattttgtagatatttcacccataactataaccattccagttgttacaactgtttcacatgcaattctagcattttcatccttagatataatctcatcaactatactatcagaaatttgatcacaaattttatcaggatgtccttccgttactgattctgatgtaaataaacttttcatttcttattccttctttcatttcttatttctatctcttttccattatcaaaaattagtatactatcaccttcaacaatgttaccttctactatttttctacttattggtgtaattatcttactttgtattgatcttcgtataggtctagcaccaaattgtaaatcttctaaataatccagtataagtaatttaacattttcagttatattaactttaatattcttattttgtaattgagctataaactctcttaactgtaaacttataatcttaattaaactatccttagacaatggtttaaaaataatactttcatctatcctatttagaaattctggtgaaaattctttaattaattcttttttaattttttgatttagcttttcttcatcatcttcttttaatatatctttactgccaatattagaagtcataattatgatagtatttctaaaattaatagttcttccttgtccgtctgtgactcttccatcatctaaaatttgtagcataatatttactatatccctatgtgctttttcaatttcatcaagtaaaacaatagaataaggtctgcagcgaactttttctgtaagctgccctccttcctcatagcccacatatccaggaggtgcacctataagcctagctaacatactcttatcttgatattctgacatatcaattcttataacagaatctatatcattaaataatattttagctaagttacatgctaattctgtttttccaactcctgttggtcctaaaaatatgaaagaacctatgggctttcttggatttgataaacatacccttgatctaataactgcattggatacagcttgtacagctttattttgtcctattactcttttctttaaatgactttccaaatttcttaactttcttgcctcatcttccaaaagatctgaaactggtatctttgtccatttgcttactatttcagctatatctgactttttaacttcaataacatctgatgaattatctctatcaactttggaaataatcttctttcttgccgccgcttcatctaataaatcaatagccttatctggtaaaaatctttctgaaatatatctacttgataaagttactgctgcttttattgctgacctgttaaactttacattatgataatcttcataaatattttttattccatctaatatatgaattgttttttctatagacggttcttcaactaatactgttttaaatcttctttccaaagccggatctttttcaatatattttctatactctttaattgttgttgcaccaatacaatgtaactctcccctagctaaagcaggctttaaaagattacttgcatccataggaccatctgtgcttcctgcacctactaaagtatgcatttcatctataaatagtattatctgtccataggaattctgaatttcagttataactttttttagcctctcttcaaattcacctctgaacttactacctgcaactagtgctcccaaatctaatgagtatattttcttatttttaagttcatctggaacttttccttgtacaattaagcaagctaaaccttcaactattgctgtttttcctactcctggttctcctattaatacaggattgttcttgctttttcttaacaatatttctatgacataacctaattcatcttcacgtcctaataccatattaaacttattttccaatgcacatttagttaaatcaattgcatatttatttaaaaaactttcttcatcactattgtaattcttttcattactaaactgaattttagataatccctctaaaattttagactcatctatccctttattttttattttctttcctaaagtgctatcttctttagaaagtgctaaaagaatatgttgtgattctattagttcatttttcatattaattgcttctatagatgctttcattataatttcttttaatgaatcactagccactatagaatctaacatctcttggctatatcttatactattcttatccttatattctgaaacgacttcatttataagatcttttacatcaatattcaataatctaagtattttataaacattagaatttttatgtttagctaacactataaaaaaatcctctacttctatccttgtatgattaaattttatagctataaattttgcttcacttaaaacttgcttaagctcattatttaatttattcataaatctacctcttccatagtgctataagtttttcttatattattttttaatacaacacacattccaacaagagttaatgttaaacctagaacaataccaataaaaacgccattctcttgtaataaaatggagaaaattaatgaacttccaacaccaaatatccaatacaataaaagtactaatacgagaggagctttagtctctttgaaacctcttaatattccagcaataattgcaataatgctattaattacaaaaattattgctatccaatacatatagttgctagctaactcaattactgacatatttttataagaattatctattatcatataaattaagctatggtttttaattattattagtcctactattattactgcatatactaagaacaaggtaaatgctgatttaataactattttattttttgctttattcttttctcctattgtttctccgactctcatagaagcagaatttgcaatgcctattggaaacatataaaaaatatttaaccattgaatgacaacattatatgctgctaaggaagtagagctaagtcttcctattagcaaacttgttgctgtaaatataaactgttctgaaaaaaaagtaaaacctgatggtatgcctaaattaataattttataaataatttttttagatattgtcccgcctttagctagcatatactttgatatttccttattgtacgcatatttgacatataaaaatatggcaagtaattgcaaaatatttgtaatacttgtacttagtgcacaacctactactcctaatccatggaaaaatttattatcatatattaataaataatttccaaagaaattaataactactcctaagagtgaaataatacttgaaaatttcacatctccatacgttgctaatatcaatctaatgaacataaaaattgtccatggaataattcccggtattaatccatatgcatacatataagacacattaactacagcactatcatgaattataaattttacaatccaaggtataattattaaatatagcacttgcactaaggcagcacctatagaaattaagtatccgtttttcattaaatcggatacccgcctattattattctcccctttagcttctccaactaaagggggtataaccatgactaatcccatacaaaacaaatatgctaataagtttagggaagataccaatgcttcacccgctaaaaatttttcgcccaatatactaatcatatacacatctatagcactcattaatatctgtgacagctgtcctagtgctatcccaatccctacagtagttaatgttttacattcaattttaaactctgatttattcttttttaaaataaacatctaaaatcatatcctttaaaactttaatagattttatttatataaatgttgtgattcctgtttatttgtatttcctgaaatagctgcatattctttttcctgtacttccttaagactttctgatgtattgtttttgaaaattgacttagtaggagtatatccatgcactaaaaattcaacaaatttatgattttctattttagccgtaatatgcatgattcccatgttgtctggtaaatagccaagttcatcgcctgtctcatcaaaatacatatctactgtatcattaacaccactaccatcaccctttaaaatttttggtttatgaggaatagatacgccattcatagctgaatttaacacatctgcagctataattggtgtaattggtgtcttgaataatggatgatatattattcctttttcactaaatagtgataaaaataatcccatattattattagcccaagcttgtccaactaatttaactaattccttggtatcaatatctccaatatcaacctctttaagttctctttctgatgttggattatactgaattaattcatatccaggcacctcaaactttgtgaatttatgatttttaattgttgcctcaattaccattcttccggcatattgcggtgtgtatccagagttctctcctgaatcgataaatttcatttcaataagatcatctattccatctcctgtgccattaattaatttacatccatcgtatactgtagttccacaaacagtacaatttaaaacatctatgacagtattaggagatactccttttgtaaaaaatggatgatctattatcgcatcttctgagaataaatttccaaatcctttaccatcatttttaccccaatattcacctgctagtccagccatttctatggcacttaaattactcatataataaaacctccctttattatctaagtgaattacttattttatatccataaatgtttaaataacttatcctatgttttttcacagtggcactaaccataattttccctatattagatggcttgtatcccatttctgttcctgtttcatcaaatgttaactcaattacatcatcttcaccactaccatcaccttttaacagggcataatctgataattttgtaattcctttagcattgcaattcatgacttctgctataacttgtggtgcttcttctttatctaatactacatgttttatttttgcatcatcactaaataatgatacaaactcattaatattattacattcccatgtttttgctaatttttctgctacttcttttgatgttaagtctccatagtctatagttctataatttatatcttctgtacttttttgcaataattctatttctacaccttttgtatctatcttataaataacgtgatctcttatataaacataaactatcattgagcctatatatttaacatcttcatcaatttgatctcctgtctcttgaaattttactctaactatgtcatcttctccgttaccatttcctaaaacttgttcatatcctactatattagtataaccttgaactggtgcattaattacttccatagctactgccactttaacaggctggctaaaatatggatgactaactaaagcatcctttgtaaataatgatacatatccatcaaaattattattctcccacatttctcctaaagtacttactatttcccttgttgataatttcttcattataaattccccctttgtattactgacttatagaaattcctctttcattaaaaatagtatttaaaaacaactcatcatttttccagtcaacctgatatatcttggcatctgatatcgatggcaaccccaatattaaatgagataagttcattctataatctgctataatagttattggtatcttgtgcgctgaagcccatccaagctctattaaaactccatctgatatataatcactaactatcgctactaaatgttttgatttaactaattcatcgtaatctcgtttagtgcattctacagaagtaaccttttgtcttccccatttctctatatctattgcaaggaaaatattatatccctccatagttagaagatcaaaaattctgttaatttttactgcagttttgctatgcaaaagtcctgtttcaggattaattgcttttgagataggagttgataaaaaaatttgttctcctcttttaactgttttatttttactcattaccctttctccttaaccaaaaatactaaaagttcctatcattttcataatattttattgtaccatcaatacattcttcaatttcatctagtatccaagacggtctaggtctattttcttttataaagaattgtgaagtttccttattgtttggtatttctccctctgttgtataaggtaaaatatctgaagttccagggcttaccactccaataacgggtaataacttttttaatatattaatatcttctcttgtagtaagaataattttagcccacggacatgcttttgctactgttaaaacactctttataaattcatcatcgcttacttcataaggtatctcttccatacctctaattcttggcatagatatttctacttctgctcccatttcatgaaattcattagcatgtttaattaaagaatcaatatccttacttacctctgttaatccaataagtattccaatatttatccttttaaaaccttttgagatccatctttttggtgttgataatctaaaattataatgagatttaggaatacttgatacttcattaccaaaaaaactatgatatgcattaatatcataagtttcttgaaataaagataaacatagtttatctttatatttatctttaaaaatattatataatctattgatttcctcattagttaatgaaccaatattaaaattgaccttcttaaatcccatatcaaaagcagcttgaattgtttctattatcatattgaaattattttctctttcttctccttctaaaaattctcctgacaaaataagtacagctcttactttttctatttcatataatattattaactgctctttaatttcttttaagctccctcttttacgtttcatatgattattacttttcctcatctcgcaaattttacaatctgaattacaataattggttatatatataggaactatagtttcaatttcatttttccttactttttcaatgctattttgaatatccttaatatcatatttatcacacatataactactcctttattttttaatggctgtcaccaccacttctactaaattatctctatctaacgagtaatttcccgacagcaatgtcactaatatgacttcaatatttgagctaatattattctcattacacatttttcctaataaatcatcatattcttctattgttaatatctcatatatccttaaaatatcatctttatttaccatataactcgctccattttataatattcccccaatttaaaaattaggggaatattacgcaaactactttttgatagctgtaacaatcatttcaagagtccatggtggagctgatggtcttcctggcaatgaagtaacatcaataattttaaaccctaattcttctatctctttgtaatactctaaacacccttcttcagtaaatgcttctaattcatcatgatccacaaatgtacgtattttttcatcttcttcaattatcaatactggattccattcaagaaataatccttctttttcccaaggttcaattcttgctacctttgttccttcaacttcctcatattgaagtattgtttttgaatcattctccaaattatccttaagatcttgaagaatcataaatgatattattccacctttttttaatgccttatgagcattctttaataacttaatttgtgagatgcgtgaaaatggaacaaacattgatataattgcatctatatcttttccacaactcatattcaatgcatctcctgctttaaattcaactaagctctttttatcagctgcaattttctttgcaatttctattgattcttcattacggtctataccaaaacagttatagcattctttttcttcaaacttcattataagagttcctgtaccgcatcctaaatctagcacagttttgactccattttcttgatatatcttatgaagcatttctacaatttcatcataatctagcaacttatgtcttaatatatcattgtacttaataattccctttggataattaattaaccagtctttttttacagaatttttttccatataaacacttcctttacttattcaatacttgaccaaaatcatatacttcttttggtcttaactctcttaaattacatccccataattgtgttttccctctattagaaaaactaaagaaacattttgaaatattatcaataaaaaattttcctttttgggttacaatcaacatattgtctttaatgtctatataatcatagctttttaacagagctatttcgtacttatatatatcctcaaattttatagaaaaaatatcttcaaattttttcatgtcaacgtttaaacatctgacccctaacgctggataacgtgatagtgcatcatcatatgaccatctttttcccatcaaaactgggaatttcccattttgaatcattgatatatactcatctgcatcatgaacattggcccaggtaaacccattaaagctttctgaaaatgcacctgctccaaagcttaaattttgacattgtgggctttgccaaagatcttgaatctgtttattctcatgacctggtaatgcataatcaggttgcgctacttgaataaatccggtttctttcatcttatcgaaaatatagttaaacatttctttttctgtctctaaactgttttgttcatctttaactttatttaactctctaacttcagggtctaaagcatagaaacttatactatgaacacctagatctaaagccatatttatatcttgagctaatccttcaattttttgatttgggaaattatacattaaatcgattgcaactgttttaaatccaacttccaaagcattttttattacctttatactcttaaatggaatttggtgaagcttaagactatctatattttctttattaaaagattggacaccaaatgtaactctattaacgccacatgccttaagtgatgctaagtaatctttaccaacagtcattggatgacattcgacagtaatatcacaatcacttaaaatatcgaacctactcttcatagtttttaaaatactatctatatgcttaggactcaatacactagcagttccaccaccaaaaaatattgaacttacttctagttctttagaaagggagttacttgaatataattctatctccttaattattgaatctacatataaatcaagattttgtggttttaatggttcatgagtaaatggacacatggagcagataaatttacaaaatggtacatgtacatataatgtagcctgctttgaattcataggaacactatcattcttcttccatacttctaatggattaaaatcccctaatctcaatggataacaccaagtataacaatcaactctttttccaagatctaaaatttcttttctatcaaatctattttgtatatcattaactgtagaatacatttttacctccctttactaatcctaaaatcaataatcttaggagtttttcctctcttagtcatatataaatcctctttgtttatttctaccttaaatcttaagctcccaatttctttagatgctgctaaatctaaagaagaatcccaaagtttcttaactatactcttttcaacttcttctaaattctctacttcatcagctgtctttactttaacaacaacctcttccaatcctgggaccaaagtgctacatactatttgataattacttaagttgattaactcaccttttaacacatcttcaacttggtaagcatataactttattccatcaaacaacactattgaatcccctattcttccatgaacctttattaaaggtaattcacatccacaagaacattttgtgggtatgagttcaataagatctcctaatctatatctaataagaggagttccctctccatatagacatgtaattacggcttctccaaacttatgattgttatttacacatttggcattttcaactggaagtaattctaaataatataagtcactcataaagtgcattccaccatttatgcatccgccacctaaaccatctgtttcttcacttccatataaatctataggttctacaccccaaaaatcctttatcaattttctatcagctggtaacattggttcgcctgccaacaatatatgtttaggattaacattaatgctgtcactagattttataatgcttattattgctttcattcttgaaactgatgtaaaaatagctgttggattataataactaattaaatcaatcatcttttcattaatctgtgatagtcctgctggaattgccataattccaagtctttcacatgcattcatagttaaatatcctagatgtgccatatcaaaaggttgtcctatataaatagaatcacctttcttaagacctgccatctttaataatctttctaacactatggaactcatttctgtatcattatgagtcctaaacaagctctttggattatgtgaagttccactactactactaactctataaatttcagcatcatcacaagcaaattcttttccatactttattaaatcttcagatgttacaattggtaatttgcttaaatcctctatgcctttaaattcatcaacgttaatattagcttcattaaatattcttttataataagaagaatgtttacctgcatgttgcaccactttaataagcttttcatttatatcttccataagttaacctccttgaatctttaagcaatttattcctaaaactaaaccaatatcatttctaaccttttacatatgtgatcaaaaaactcttcccctgctttacttgttgcccctttagaactagataatgttccgtttgcattctcatcctttttttcatctgaataataatatatccccgccataggtatattgctgcattcttcattaataaatctcaccttttcaggtcttagatacaacatcaatgaagtttctacaaatccagcatgttctgcatgccatcctacgaaattattattaaattttttcttaataaattcatcatctatagcactccaccaacttagtgcaactatactcataccttttagtagatttctttgtctgcatatttctatggcttcaaaaataaacgcttcattctcataatgaccatttataatatatagattctttagtcccatttgacaaaaagaactaattatatcaacaaaataatcaattaaaacctttccattaatacttattgtgcctggaaaatcacttccacctccactttgtggtagtgatcttgctgcatacattatttgaggtcccataacccaatttttcctgcagcacaatttcttacatatatctactgtgatatctatatctacagacaatggcaagtgtggtccatgctgttctatagttcctacaggcaaaaccaaagaattattattcaacaattccataacaacaggagacgtttgatcaagataatttatacattctcttttcatcttctatatccgcctcttttctttaatcttttaaggctttattaattatctctggaacagttattcccatgtctaaaaacatgtttttcaaatcatggattattctttctacttgattaataccattaataaaaatacatgaacatagctcaacagcgctacttcctacataaagatattcaaggacatcatttgcattttctattccacctattccaataacttcaacatcagcattattttttttaagataatatatgttcttttgaactattggttttatagcaggacctgaatagccgcacctaacccctaaaggtaatgtaccatcagtattaacaactattgcaggtatactatcacttatacttactgattttgcaccagcacacattgcttttctaactttttcttctaccttaacttctgatgtcaatttcacactaacaggtacagatacttccctacatacagcccttgtaaaatcataaattttctcattaattccaatttcattaggacatgatattcctaactccaatgctttacatccaacttcctccatttgcaatgccaaatttaccaattcatctttagtatctgccacaatgctgggaattacaggaagattctccttatataatttacttaaaatttctgtccattcacttattgatttctttgaatatgttgttgaattgaatatttggctttcttttcttaatattcttccactttgaatattcttttcacctatatatattgtttttgtaattactgctccaacccctaaatcaaggaatttcctaatacttttttcattatctgttaaattgcttgatgctattattacaggattttttaacttcatacctaaaacttcagtttgtaaaggattaattttctcatcatttttcataatcttttttacctacttaattgtctgtggtaatgcccagctttccatccaactttttggaatatctataccaaactgatataatgccattgccatcattccttgatggaatacttcatgtgctattaagttagtaagatgagtttccaacgctatgctaatgtcataccacttaattactttattgccttttatattattaatacatttttcaagtctctcatcgctttcttttaaaccatctaatagcttatctctatttaaatctcctgaaaaatcaaatacatctggaacattatcaaaactcatatcctcattatcaatagctgttataaaagcattttcaacagaaatcatttctttaatgttttttacaaaagaatttaatccaggtcttgtccaagctttctttaattcctcatctgataattgatttaatatatcataagtaagttgtctattagctttataagtttctaaaaattcacctaacatctattaacactccattcattttttattttccttctctaatatttttcaagtgatgcttatatatttcacatttgtatttaatactttcttcattaactgttttgaaactacgtttcataaataaacatctttcacaaaaatgcttaggacatatatctttctcagtacatgatttgcactgttcaatgcctgacttatgattaattaaggctaattcccaattttgaaccaatatattcataaaatcatctatagaattcatattaaatattgagcctatactatttactttccctgaagcaatggcacatggcaatatattcccaaatggatctacttttaatgtaggagtacaacagtaatcatagttatatcctgaacgtatccatgctaataattgatttatcctatttactgatatataagtatctttattatcctttaataattcacctagaaaatactcttctatttctatctgcttatttaaaggtggtgctattttactccaattatcatttccatttcctgaagctatgagtgttggaaagtgtactgtccttattttattttttctagcaaattctattacttccttaacatcagtaatattttgattcataattgtcattgataatccaatctttttagcatatccttcctcaacaatatcttgaattgtatgcattgcttttctaaaatttcctattccacgtatattgtcatatgttttttcactaaatccatctaagcttatttgcaaaaatacattgttatttcttttaagaaaatcaatatatttttctgaactccaggctattccattgcttgttacaacaacttttcccaccttacatagtccttcaataatcttttcaaagtccttatgtaaagttggttcgcctccagttacaacactatctttaattcctaacttgtataacttactatgaaactttaaaatttcatctgcatctaaaaaagttcttttttcatcagatacattgcaacaatgaatacaattcaaattacatccattagtaacctcatagtaaattctgtctgacaattttaacggtttcattgaaatctccttctactttgttacttaaaattagaattactttagttttaagaaagcagtctctaaaaattagagactgtcttcttaaacattattgttctactttacagcagattgccatcctgctgctgattgccagcctgttgcggattgccaacctgttgcagattgccaacctattactgactgccatcctgatgctctatttgcattaatataatacattagtcgattccacatactttttcacctcccataaaaattttctatcgtaaaaagcaaatctcttaatactataaatcctaagtattatcttttgtctccttacgatatctacatattactcctctttagatggtataataagtcacaagtttctatgattataagggaatgtgcaaaaatccaactcctttagatgtgggatgtatagtacaagataatataaaaaataagaggtacattaaaaaaataaaatttaatctttattctttcaatgcacctcttaatctttatttaattttcacatcaacatttctaatgaggcaagtttacccaagctctaaaggtcagaccaacctcgttatagtgcaaaatttatatagctaacttataatcttgttgcatattcttaacttttaagttcttaataactgttgattggttttatctaattaatttaattgatagcttaagaaatctgttttttgatttgttatcatttctacaactacctgtagcttgtcttatctttttctttaatcatcttatgatttttacttaaataaatataataaataagtccataaaaattttcatacatgtgtcttgactatccactttttcattattcttgctttaaatattaatttaagattacatccaccatagtattcactttacatagtgcctcttttgtactattagcctgtaattttttcaaaatattagtgatgtgatttcttatagtttcatccgaaactactctcctacttgcaatttcttttctagtcaaaccactttttttcaaatttaaaatttctttttctgtgtctgtaaggttaaatttatctagaactttattaaatgtaatcttatctaataaattgctgtaatcatcaaaaatattttcttttccctcccataacattaaattttctattatgcacttaataataaatttaaaattatcttcatttaaatccttacttatacaggctgatatattagataaaacatatttcctatcacttgtaatattgataaacataacaaaaattgatggcaaattttctgtaactgctttaatcaaattattaaacttatcagttgtatcttcaaaagattttaggattaatattagttctggttttgatgttattaaactatttctaagttcttcttcatttaaatagcatccctgaacagtaatattgctattctctatcaaaaaaataggtatatctatatcacatacacttgatgaataatatattaaagcactcaatgccttcaaacatacccctcccttttcccttctttttcttttttttctatttaatactttatagtttatatattattctatctttttctttttttaagtactaaaattttatgacttgaatatttaacattacttccattacttataaattttgtatattttttaataaaaattaaattatgaaataattatgcaattttttaatattaaaaaaacacgctaagctcaatcaaataaagcttaacgcgcctcaaaattaggctgtattttaaataagtgttaaaaattgatatatatttacaaatatgttatagttaaactatatatacaagattgaaaatcatattatagcaaatgcaccgtctttaattttagaaacaggtgaaacaaaaataattttttttaaataattctatcattaagattttatcttattttcttattgatttaaatagaatgtagaatatctatatttcaaattttaaaaaggaattaggtgaacagcgatgacaaagaatgaaataatagaatacctaaataagattagttctgataaatttaaaaataatgtagtgaagatggggattccagaagaaaatagtataggtgtatctacaggggatataagaaaacttgcaaaaaaacttggagtatctcaaacattgtctaatgagttatgggaaacaggataccatgaagcaaaattactttccgtcttaattgctgatacaaccatgattaattttacttatattgataaaattatgaaagatgttttatcatgggatttgtgtgaccatgtatgtaaaaatctaattataaacataccaaattacgaacgatttattttcgaatggtgtgatgatagcagaatatattataaaagagcatcatattgccttatagcaactacagtaatgcataataaaaatcttgttccagaagaaattgatagatatttagatttaatcaaatcttattctgatgatgatagacctcatgttaaaaaagcaattagttgggcattgagagaaattgggaaaaaggattttaattatcaagagaaagcaattattttagcctatgaattttgtgaaagctcaagtaaaaatatggtttggataggcaaaaacgctctgaaagaattagaaactttagtttctgttgaagagcgtggtcgattaataacatcaaattctaaaatgggcaaaaaaaatagattattggtataatctatagtcccaaatttcatatataatttccaaaattatactgctaatttcataggattctaaaaatatactgttactattaactatcttcaagtgctatccatctcccactttagaagtgggagaatttcacacaattaagttacaaactaattcttttgaacctcacacgactaaagtcgcgtgattctttatacgttgtttggtatttaagtttccacgtattactacgccacccttaaacgtattggattgtccaaaaatccattatccattatctttattaaagactttggagtacattttaaatactttctcataatattataactaccattgacatcagcatttattaaaatacctttattacttttaaacaaacctctatatattcttctattcttattatatttatctttacctatttcttctaaatctaaaacactacaaccacttgtatatgattcattttgtattactactttaattcctaataatttagctttatacttaatcttttctactaattgttgttgtggtatttgtacaaatgatttagcagtattctcttgtttaattcctttgaaatcacctattacaatagtatgacatctattaataatagctaaatctatgattctcttacttgatttatgaatataatctttaatgaaattatttcttttagtttgtaatttaattaattgttgtgttcttttaaaatatttactatttttgtattgtttcattacgatagaagttaatctagctatttctttataatagtaactatttttagatttaacatatttaccatcaataatataagaatgtatattatcctcaaatgttatagtagctaaattattcaatcctaaatcaatgctcataatattataataatctttagctatatttacttcttctttagcccatataatatttaaattccattgttttttagaattattccattgtattttgatttgtttaatggttattaaatctacaggtattttgattttagacaaatcaaaatttaaactttgaacctgaaatttatttttaatttcttttgatagagataatttaagtatattatcttgtaatcttatagcatgttgagtaaatataatttcattctttttattatttgtatttttaaatttaggttgtcttggttgtcctaaatatttattaggattttttttataatctttaatgctagcaaaataggacttccaattcttttctaatatctttagacattgttgataattatgactgtgtaaaaattgcttgtgataattattattgtatattttattcatttctacataagatttgaccgtatcttctctacaattatagtttgctatattatataatttagtagtatgataagataactcttctattatattcaattgttgttgatttaatttaggataatatttaaaacttaatttcacgattttttcacctcgctttctataatttaattttatgaaattaaattatagatcaaacacttttgggaattcatcccatgactaaagtcacgggtgttcttgccaaattcataaaatttatttgtaaatctgatcctttcattgcaattttaattaatatcactttccttatttagccactcaattgtagtagtcaaacatttgttgcgttgttctattttacaagttggtgccttaggacaatgtgtacagttttcccatactaactgttttgccatatcttcttgacttctaatcaatctctcaaaatttgtcatacaagcaaacctccttcccttaagttaaacattgaattctgcttctttagcctcaataaattcattttcccaaaactcatctttttgtttttcaagctttttatctaatacaacatctacaggtccatcgattaaattaaaataattgatataggtattatctctagtgtctctaatccaatccattgtaattatacatttgttattctcttgtaaagaaaaatctaataacgaataatacactttgaatccttctttagtttctaattctactgtctttttacttagatcatcaataatttctaataataaatttttctctttcttctgttcatccaaatctattatagctatattaaaaaaatcatctttttttataggtaaaataaaatctataagttcatttaatactttgttttgcatttttcctataagagaaaaatctatatctatttcatttattatagtgtacacacctttctttttcttgctttttttaggtttgacacccctaaatattggaatataaacatctttaaatatagtatccttttgggccccttctagtactttaatatcgccaactatatacttattaccattaatattacttcttgaatttattctatctatttgacatttaatatttgatcctaattgaatatttagttctgcaacataattagataagattatttgtccttcttttatcatacttttcacatacctttcaaatctatttattacatatactagtttttttgaaatttttcacaatacaaaagtacgattttttttaaacaaaataataaatacatataaataaagattatggctttaaaagctaaaataaagggaggattttacatgaatacaacttcattaatcggaaggattgcaaacaatttcgaggtaaaacaagtaaataatatatcaattactaattttaaattagcagttgatactagcagaaaaaataaagaaggaaatggatatgaaactgcatttcttaatatcattgcatttggcaaaactgcccaaaatacccataagtatatgggtaaaggagacacaatttcggttacgggtgaattacgtagccgtatgtatgaaaaaaacggaatgaaaataactgttatagaaattgcagctaaaaatatagaatttattaaaaaagctaaagcaaatcaacaacaatcacaaaaccaaaatggttataataatcagcagtcagtaaatcaaagcgaatataacaatcaacaactacaaaatcaaaatatttataatagtccagaattaataaatcaaggtggatcctataatcagcaacaaaatcaaagtggatataatcaaccaatacagaatcaaggtggctatcagcaaccagtaaatcaaggtaattatcaacaacagccacaataccagagctttagtggctttgatgataatttcataccaccaataattgaaggtgatataccattttaaaaattaagaaatataaaggaattaattagtatataaaaatattgtgtaatatattcaaaattattgcacaatattttttgtaaaatttaaggaggaatcataaatgaacataaaagttaatggtggagaatttaaaaaatatataggattggcattaaaatctacagcatccagtgctgttaatgctaatgatataattaatattagtaccaataacgacaaattaattatattatctggatcaagtgattttacattaaaacaagaattaagtaatataataatttcagaagaaggtaatataaatattagcgttaccatattaaatgctattattaaaaaaatgtctaatgaagaaatatcactatttatagatcctaaaaataatgatgttttaaaaataaagcaaggtagaaataattcaaaaattgctcttgcaaaagagcatactatatcagatattttgaagtctgatataatatatagtttaaatcttaatccaaaaatatttaaggatttaatagaaagcacgtcttatgcagttgcacaagatgaatcaaggcctatcctattaggacaatacattgaattagaaaataatttaattaaaattacagcactagatggtttccgattaatttctaatagtgcaaaaatagaaaataaacataaagataaaatattaattcatgcaaataacctaaaaaatctatcatcattaattgatgatagcacagaagaacttatattaaataaaaataataataaagcaatagtagaagttaaaaataaaaactatgcagctattgctgcttctaatattttttcagaagagtttattgaatataagcagcttataggggacttgtcatcatttcctataaaaataaccgtagatagattacaattattaaatactgtagatagaatttctgtagtttctagttttgttaaagaaggtactcatatcttaatgaaactaaataaagactcaatagaaattgatggcaacagctctgttgcatcaatgaaaggtgaagtaaatattaaaaataacaattttgaagaagaatttacgataggatttaatcctaagtacattcttgatgctttaaaaaatataaacacaaaagaaatagatatatttttcaatagcaatgtatctcctgctattataataaacaaaccagaaaaagcagaggatattagtgtaaatgcattagtccttccagttaaaactattagttaaaatttcaatataaaagatccaactatatttaatatagttggatcttttgataatcagcttttcatttatacaaaaataatattttatgtcaaattatattctttctttgtattttttcatattttcccttattataataatatagtataatttttcttgaaattcatacgaaaagtattttataagaaataataattaattatataaaaatatatggcttatttggctaaaatttaaactaggaggagaaaataatatgttaagcaaaaaaactaaaaaacttataacatcagcaatattaagtttaacaatatctctatcatttttggggactagcataacagaagtaaaggcttttgatagaacaaaagccgtttatgaattaaaaaatgctagaacgtatgaatatacttcgagctatgatatatctatcaacagagatattgattatgcaagaggtgaaatatatttaggttcaataagttctacagcacatcaattagatacaacaccatttagagctactatgaacggagaatctctaaaaatatttaatagcactaaaaattcattggaagaaaaggaaaaagaattactagctaaggaaatggataattcctcgaataaaaacaaaacatttggaatttggcaacaagatttagatggaaactttagattatatgtgtatattattaatgctacttctggctttaacaaaacattaaaaatatctaaagaatttatatctggtgatttggattatggattatacaagaaagatactaaagaatttagtgataagctaaaagaagttttaaattctccatatgacaaatctgatttactaagaatctataaatatgatattaatccagaagatggaacaagcaaaattccttatggtgaaaaggaaattatagataaaactaaagaagttactaaaaattgtacgaatgatatggaaagggttcaggcaatatataaatttgtggtaaagcatatggattatgttacagatagtgaacatagcaataaaggtgctttatcagcactaaaatatcatgaaggagtctgcgaagattatgcatctctatttattgctatgtgtcgtgaagtaaatattcctgctagatatgttcatggattaagcggagttagcggtaatcacggttgggcagaattttatttaccttattatggttggattatagcagagcctacagtaaaaaaccttaaaacagtaaatgaagaatacttacagcaagcaataatgaaatttgtaggaaattataatcagaatgatgatttcataccttctcattctgtagcaggctataataacaatgaggatagataccattcgaaatttccttatatatctgctactcgcaacaagacaatagtaactataaaaggtgagcctataaaaagcgtagtatataatcaacctttctctaactatcaagaaaggatagattcagtaaataaattattagaagttgcgaaaaatagtaaaaaagaagaagatataaaagaggctaaagaactagcacaaactttaattgatagtaaagaaagagaaactatattaaagcaactaagctatataggtaaaagtgatgagttaaaatctcaaataggtacacttgtagtagatctagaaaacagtgatacaatagatactaataaatttgaggaattaaaagaaatattaaataatgcacctgaagaaattgtagaagaatttaaaacaccatattctaaaatagctaaaagatatgaaatagaaaatcttattaaagaaacagaaggaaatttaacagaagaaaatttagacaaactaagtaatcttcttgataatacaaatatagaagataaatataaacttagctatatatccaaatatgataagcttcttaatgactacacaaaaaaagtagaagaacaagaacaagctgaatatcaggctaaattacaagctgctacaaaagcagttgaaaaagctgaaactagcaaaaatcaaactgatgttgataatgctagaggcttagctaatagcttaaaagctactgataaatctaacttaaatgctagattagatgaaatacaaaaaactattgatgataaaaaaacagaagaagaaaagcaagctgaatatcaagctaaattacaagttgctacaaaagcagtcgaaaaagctgaagccagcaaaaatcaagctgatgttgataatgctaaaatattagttaatagtttaaaagatactgataaatctaacttaaatgctaggttagatgaagtacaaaaagctattgatgcaaaaaaaacagaagaagaaaagcaagctgaatatgaagctaaagttcaaactgctataaaagcagttgaaaaagctgaaaaaactactatatatgaagattatataagcgctacaaaattagtatcagaattgcaggattcagaaattcaaacacaattatgggatagactacgtgaagttaaagttgatataggtagaaaggaagaagctacagaactagtaaaattagttgaagaagataatacagaaacaaattacaatagagctttagaatctataaatagattaagagataatgaacttaagcaagatctactaaatagacttaataacgttaaatctaatatagataacaataatgcaaaaaaagaagaagttaataaattagtagcacaagcagaaaaagacaataaagaagaaacttataataaggctttagctgctgtacaatcactagaagatgatcaacttaagaaagaattattaactagacttaataatgttaaatctataatagataacaactctaaaaaagaggatgttactaaactagtagagcaggcggaaaaagataataaagaagaaacttacaataaagctttaactgctgtaaaggcattagaagatagccaaactaaaaaagatttattgaataggcttgataaagttaaagttaatatagataaaataaaaacaaatgaagcaatccacttggttgaatatgctgaaaaatatccttctataagtacttataataatgcaaaagatgcagttaattctataaatgatggcaatacaaaaacagagttattaaatagattgaaaaatattgaaatcaaaatagaaaaactagatgaagaaacaaaaacacatcaatttatagactatgtagataacttagttagagaagctgaaaaattatgcacagaagacgcttatagaaaggcattagaacaagcacagaaaatagaagatgttcaaagcagaaaagtttatattaatagactagatcaagtaaaaaataatatagatataaataaagagacagaaatatctcctattagaactgaattggatagactagagcatactataaacagtataaatactgtaaataaaaatgatatgcttgcaataaaagaaaaaataaatgatttaaaagatacaaaagaaagacaggatttaatagataaattaaataatatagaaaacaaatataataaattaattaataatcctaattataataaattaattaaatacaatacttggaataacattgtatataaagaatctaaagataaaacttttgctgttaaatttaataaaaatattaattctaatgacataagtaaaaatttatatttacttgatgttgataactttgaaaaaattcacgctactattaatattaaaggtaaaactgcttatattaccgctgataaattatctccaggtaaaaaatatatattagtagtttcagatcaaacaaaagatatcagaaataaggatttaaagcaaggtttaaaaacatttatacaaattatagaatagaagtcaaaataaaaggacttaggcatctttacatgtctaagtcttttttaaatataatattcttctataatattaataccttattgtattttttaactaagatactacctttctgaaactcccaagcctaaaggcatggggttcttaggtactatataacttctatattatctccgaaagtataatatcactaattattttccctaagacttttactatcaaagattaatatcaatctattaatgatagtataacgcccgtttcaaaacgtttaataatttatatacccatgctgcttaaattatttttagatccttgtagtcttaatatttctttattatgaagttttaaaaacttatcaaaatctttttcacactgactattattaatactttttaaatcactagttacattttttattaaataactagaatataagtctctctgtactttaatttgctttccatcataatcaaaataattccatcgttgactaagtttctttttattatattctttatttaaatgattatattgagatgctttcacttctctagtatttatcttataatacaatccacctttagcttttaatttgttctgcaatatagctaaaaacatacttggtgctttatttgctagtgatttaccaaatctttttttccttttaaacttacctttatcattcttttctgtgcttttactacgtttctgaagtgctttataattcatatcttcaacataaaccgtatcacaattttttagtattttattaatcattatattgtggtcttgttctcttatatcagcttgttttctatataaatctttaagtttattctttgcttttatatatttatttgaataattccactctagtttaataccgcgctttacagtgccatcttcattaaaattattagaattagttgctcttttactcctatccatatatcttaatattttgcgtttttcattttctatgttttgaactctaggtgctaattctaatagtttacaatcataatcagatgtataagcaactgtttttgttcctatgtcaataccacaaacacctaaacctatatcattcttaacctcaccttgtttgttaattttaataggagggatgccttctaggattaattgtaaaatgtatttgtattttctacgaacaaattttcttttaatcctacaaaaacatattttatctcttaaagctctgtttcatatttattattaatatctaatttgactggtatttctagcccattccatgagaacatattagtttctatattatatctaattccagtaccattagatttaccttctaaagaattcaatggtttgtttacacatttgaaatgaatttcttcacctttaccaaataaactatcatctatagctttataaactctagtagcaattttttgagcagtaaaactatctatattctttttaaaatgtctttgtatttgtttaacatctgcatgaagtgaatactcatttaatctaaattcttttaacatattgtttttaatattaaaatatagcttacaaagtttatttcttttcttatcatctttttcgactttatatatatttgatatattattttgattctttctccatctcttggttttaatcatttccctatatctctctaaggcttgacctaacacagcattatatactttccttcctatttcaaagcgtttatctaaaatattttcttgaaatggttgagtttttaattttaaatttaaaacatatctttgtttaggagctttagccatgaatattcaccttgctttctagtatctagcttttttctaaaatatttttgtatatatgcataatctcatattattgttataatttttttaatctatttttacaataaaaaactttaattatttttcctctatatctaggataaagtaaaaaatatatattagtattttcagatcaaataaaagatattagaaataaagatctaaaataaggtttaaagacatttatacaaattgtagaatagagaatatactaaaaggtagcaagacttatatagtctttgctacctttctattatacttctggaactgtcgctgcttctctcaactctttaagctcttcctgaaatttcaatatttcttttattatattttgtttatttctagtagtgaagcttagttggtttgctttagatataagctcagtcatttctttttcactagctaatatactattcctttcagcattctctttatacttagttaatgcttccatgacttctatatatcctttagctttatccattctacttttatattggctgctattatctaatctatttgttgatttctcagcctctttatataggtccttaaattcatttaaattatttattatattagaataatttagatatgcatctagtttttctactgcatctcttgcttgtattgctaaatcaatctgtgatactttattagttgtgtctagtcgtttttgcaattctatttttatatctgaactttctaatttatctatagctgcttgcgcttcttctattgttttaggatcttttgttgctatagcttttcttattaagctttctatatttcttattttattacgttcttcttgcttactttgattttctttacgatctatatatggctttaaagcatccaatactctttgcaattgagctttttcatttttatatatagttgtatttagatcatgaactgctttttttgcatattcataatcttctttatctaaagttgtctttgcttttttaacagcattataagctttaatataagcatccttttctgcttttatttgtttttccaaatcatctaatctatcagttagatcatctttgtctttaccatctggcaatttagctaccttttctttagctctatctatatcatcttcatttttagtagtctcagccttttccactgcttttgttgcatcttctaaatcttttttatttttgtcttctacattaacatttacttcagaagatgtactattttggtcattcatatttcctgcattatctatggccttaacttttatcttatgaacacctggagataaggttacttctccagtatatcttacaaattcaccattatctattttgtagaaaatttcttttataccacttaatttatcactagcagctatagtcattttatcatctttaacatttatattagccgttggtaattctttatcaattctatttactgatacttctttagtagttttattgcctgcttcatcttctaccatgaacttataagtgccattattttttacagtaaaggttgttttatctccatttactactttaccgttaggaagtgtaattgatttaacttttttgttatctttagcagttacatttaatataatatctttattagtccaatctacaggattacctgttacttctagtgttggtgcttctttatctttatcttctatagtaacctcttctttgatatatatatcattatttaaatttcctgcgttatctatagcattaacatttattgtatgattacctgaaggcaaagtaacttcaccatcatattttacaaattcaccatcatctactttgtaaaacacttcttttataccactcaaactatcattagcatctatagtcattttattaccttttacatttatatttattacaggtaattctttatctattttatttactactacttccttagtttctttattagttagttcatcttctaaaataaatttataagttccattttcgcttacagtaaaagctattttatcactatttactactttcccatcaggcaaaataattgatttaaaactacccttagcagttacatttaatattatatctttattggtccaatctacaggattacctgttactttcaatcgtggttcttgcctgaattcgtaataatctgtatgattattaccaacattatctataactgtaactcttactttataattttctgatgctaaatcaatacttatatgattttttgcgttttgtgcaatttctccggtatattttacaatctcaccatcatccatttgatacaaaatttcttttataccgcttagactgtcataagcatctataatcaatttattaccttttacacttacattggttattggagattcattatctatcttacctactattatttccttagtagttttattaccagccttatcttctactacaaacttataagtaccattttcatttacaataaagtcggctttattagtatttattacttttccattaggcatagttattgatttaacacctacattatctgttgcagtacaagttaaggttacattaccattagtccattctgttggattacctgatatagctattgtaggtaattctttatctatgttacttatatctatttgtttactagtcttattacctgcattatcagtaacttctactgtataagttccattagtagatacagtatatttattgcctattattacagtaccattaacttttatatctttaataccacttaaagtatcctttgcatctatattaatatctacattagcattagtgaaatttgttgcagaggttgttaaatttaatgttggcaattctttatctattttatccactactatttctttagtagttttattacctgcttcatcttctgctataaatttataagcgccatttttacttacgataaagttcgctttatcactacttactgttttaccatctggcaaagttattgacttaactttattattatccttagcagatgcatttaacataacatctttattggtccaacttgttgtgtttcctgttacttctattgttggtgattctttatcatcaagttttatatgtttatgtttatctatatatatcactggtgtactaggtttcagatttaaagtaggacgaacgccatcaccaatcctattgaaattaatgtcacggtagttgctagtaccgttactgtagacatagaacacatcgacgtcggtgcctgctggaagtgcttgaagggttagagtagttggaactctagtccaatatgtccattcataatccttatccccaaattttgctatccttgaagcattatcatgaaaagcattaaaactactaccaacaggttttgaattacaaacttttagtcctatttcctcaagagatggaataaatattttatcatcagtataatagtcttctttaccattaaaatttgtatttattaaatgtgtttctaatatatttgctttcagatctttacttaacttattataaaactctccatttaagtatgccctcaatgatgaattaccccaatggctactaggaagagatttagtatcaaaaggtcttttttctaatatatctttgctcattacagttacagaaccatctggatagccttcatgattcttagctactactacccaatcaatacctgatatattaaatatatcacctaccattaacttatttacttctactgtatctcccactttaatattatcagctgcaaaagccttattatcttttacaatacttaggctattatcttgcatacctatacttataggcatagctaatattgttcccaatgtggttactcctataagcgcttgtgttatcttcttgtttattacttttttatcatatggcttcatattatatcatacctccgaaatgtttaattaattttttattattacaattaattattatttaatatttaaaaaaccgtacttctttctaattaatttctaaaaaaatattgatatttagtttatatacgaagcctacaaaataaaaacattttatatccatatatttatatatacctatctttttgttagggtttaaaatttgtaccctattgaaaatataaaaaaacactagatacttttatacctagtgtgttatacattactttaattgttactttttcatatcctcttttaacttttcaacttcttcaatagataagccagttttttttgctatcatttctactgagagtatatccattaaattttttgctatttctatagctttacttttttccgcttgattcattgcttcttctttctctttttcaaaaatcttttctaccttagtcatccttaaccaaccccttaccgtattagcatatttttcatcaataaacttatcagtagaagttaatacccctgctataatgaaatactgatttttttcatcctttacttctttagctaattctatggtatctttaataagttcatgtttatcctttatgcttttcattaaaggaagtaatattaaattcataagatctatatcttttaaatttatgccatctttaatcttttgctcaacttctttataaatagtatctccatcatagtttttcataaacactgattttacatctatacctacacttcctatattaaaatggtcctctgctctttcaatattacttgcatatattacagcaacatttatctttttaatagatttattctcttcataatacttccttgaaattcttaaaacataatcaatatatttatacatattttctgttattctattgttactttcatactctaacaaaagtattgagccatcttctaacaaaaaaatactatctgctctacgttcatctgcctttacttctggaaattcatttggaagcatttcaactattttaggataatctaatccatacataatcaatgctttatctttaaacatttcacttaaagttttaaaaagtacatctttagcctgataagttattcctttagttgacaaagcaccatctccttctaaatcaattatacaatatactattattattttctatataataaatattctagaattatatgtgtttgaccttttcagatttattataaaatatgaaaaacctgctaatatacaagcaggtccttctataaatacaaattagaatcctatattataataagtttgtgcacccttgaatcctaaatcattagttaatttttcattatggtgtaaattggtagcgttaaatccgttaacaggcaccttaatttcagctttacatggtatctgtactaattttcttattgtttgctttgtacctttctcttcatctagagtataggttctagaaacataggcttctgcaataaagctaatagttaggagcggattatcaccggcataatcaaatttaaatatgcatgttcctccactttggtctagtttgcaataatatggagaagtataatgtcttccattaccaccgaatctgtctaatctatgatttactgaccatttttttatagtagctcttactccatcaatatatacaggacttaaagatatattcatggtatactctgtttctttgcctttttcgtccaggtgatatctggtgaatgggaatttagcatcagtatttattatcatatgtgctgatccgccactgcttccgccactaccattgctacccatattgggagtaaaacctgttgttttatattcccatctataacgctttacttgccttgtcttttgtactggtcttgttttttgtacagttttgtttctttttatataagcacctacttgataataagtaaatatctctcttgcccctcccttaactttaggatctcttgccttataactttgaacataaccatatttgttaaaaaatctatgagcaagttcagataaatcactgttaaagctatcatcacgaataggataatgagtttgtgtccaaatccaataactagcatcaacttgtacactatacttttctgtagtccaatacttttctgtagtccagtagccaactctttccatatgacttgtgtcaatataaggtggttgtttgctactgcttttatcattgtaaacactagctgcagatacaaaagttgattgaaatattaatatcattgataaaaacatactacttattaatttgattttcttcatattttcacttcctaacattatctataattaattattatttcaaaaaataaaaaacaactatttcaacttaaaatagttgttttttatttaattaataatacaataggtaaatatatcataagaattatcaggggctttttttatagcaactaacaaatttttaggtaaattttcaattgggaaacttatacaaggggaagtgccatcctctccaattatagaactaaaatcatgaatactacactcagaggttttaaaatattgaccattatctattttaaatccattttcatcagcatatacaatttttgcaactaatactgggaaattattaaataaatcttttatataatatggttttttataatcaattaatgtataactatatccttgtgttcttagtacaattgcatttttaattaaagcttttttgttccaagcattgtttttatcatgtgaatctgatgaataaggttcattaggtacaataacttctctactagtattgccatctaaaaaattaagctttttactaccaagcataggatactgatcaccaaagggattagcactaaagtctcctttataaacagttactttatgaccattaatccattgaatttcttctttaaatttgttagctggatttttctgagcttcaggtatatatttagaattaaatccatatttgcaatactttattgtataatctttcttttcattaaatagtattaaccattcatctagtttgttcatagatttaacaaaacaggtttgggtagttttattaactattttaggcgcaattttatttttatttattctagcattatttacaatagcaattaatagtgcaaacactattaatttagctatttttttcttattcataatgccctcctttctataatttgtttgaaattatttaatataatactgctatcttttgaatatcttttagttcattattttctttatatatttttactaaagtatttttaggaaaacatttttccaaatcaaagcaagttccatcataggctacatttaaatcttcattaacaaaacttaataatatatcacctttttttaggttataatattggccattatctaatttaataccatttccatctgaggatacaactttagcataagttgtaagacaagttgcagggtgttctttatctttaactttattttcaacagtaaaaggtgctttgtaatttataaaaaagtacatattatcaataccacctaaagttgctttttgtttaaatgcatacatacttttgtattttgtttttccagttaaaaatttttcatttaaattcatttcttctgatccagtaatttttgatttaccattactaggagaaattattgtttcagctacaaataaatctttattagatacatctaataatttttcagtaccaatataaattactgttctctcgtcagtataatctactttagcagctcctttataaatatttaaagcacctttattaatagtttgtttttgtatagtaggatttttatttatttcctttttatacaattgttcttcttgtgtgggctttggattttgtgttggctttttagctactgatgttgctttagaactattaaggcccaccactattccacctactataactacacaagcaataattattgctgttatcttctttttgttcatataaattacctccaaattatgtttgtatttatatattatttctatttttaacaatgtttatatttatatgataagttaaaagtattctatacacaacaaaaaacctaacttatatgttttaaaaataagttaggttttttgttgtgttttaatttttttcgattagtatagtagtataacaaagctgatgaatacaaatttaataattatttagaagggaagtgtgattatatgaagtatgcttaaacaattttgcttttctaatggctattgtatatctaaattattttcagatgttgctagtcgcattagttttgaaaaaagaaaagaatttttatatatgcttgatgatataattagtgggaaagtagaaagagttgttataacctataaagatagattatcaagagtaggttttgaattattttatcatttgtttaaaaaatacaattgtgaaatagttgttatgagtgaaataggttctcaaaaattagatagtgaagaaatattcgaggaaatagttactttactccattgctacagtatgaaattatattcaaaaagaaaaggacaaaagataaaagaaatattaacagaaagtgaggtggatgaaaatagctaaaaagaaagacaacactttatcaagagttgaaaaacatattataaaacaaagtcatgaattatatgattatttagataattattgttttttatctaaaaatctatacaattatgctaattataatattagacaaatatttattattacttctaaattagctaaagatgaagaagttactcaagaacagttagattacttaaaagatattaatactgaaatagatgaattcaatgaattaagaaaagctaattttgagaaagctaaggttaaagctcataaagagaataaagagtttaaatagtaataatcattcagtattcaaactcaactatcatttagtattagtaataaaatatagaagaagtgtcatagataatgatatatccaatagattaaaagaaatatttatgtatatatcacctaaatataatatagtattagtggagtggaatcacgacaaaaatcatgttcatgtattattttcggcgcatcctaatagtgagttatctaaatttattaatgcgtataaaagcgcaagtagcagacttattaaaaaagaatttccacaaataagaaaacaactatggaaagaatatttttggtcaagaagttactgtttgctaacaagtggtggggcaccaatagaaattattaaacaatatataaaaaatcaaggaataaagtgaggtgaggatatgttaaaggcttataaatatagaatttatccaaatgaagaacagagaatatatttagctaaaacatttggatgtagtagatttatctataataaaatgttagcagatagaattaagtcctacgaagaaaataaaaatttagatattaaacaaattaaatatcctacgcctgcacaatataagactgaatttccttggttaaaagaagttgatagtttagcactggctaatgaacaattaaatttagacaaggcttataagaatttttttagagataagtcagtaggatttcctaaattcaaaagtaagaaaataaattattatagttatacaactaataatcaaaaaggtactatatatattgaaagcaataaaataaaaataccaaaattaaaaactatgataaagataaaacagcatagacaatttgatggattaattaagagttgtactatatctaaaaaccctagtggtagatattatatatcaattttagttgatacagaaaatattatattgcctaatacagataaaaaaataggtgtggacatgggattaaaagagtttgcaatatgttcggatggatatagagaacctaatccaaaacatcttagaaagtctgaaaagagattagcaaaacttcagaaagacttatcaagaaaacgaaaaggaagtaacaatagaaataaagcaagattaaaagtagctaaattacatgaaagaatagcagaccaaagagcagatttcttacataagttatcaataaaactaattagagaaaaccaatctatagttattgaggacttaaaagttaagaacatgcagcaaaatcatagattagctaaggctataagtgaagctagctggtcagagtttagaaggatgttagaatataaagccgaatggtatgggagagaattagttatagcacctagtaattatgctagtagccagttatgctctgaatgcggctataaaaatgaagaagttaaaaatctagcacttagagaatggacttgtcctcaatgtagtgctcaccatgatagggatataaatgctagtaaaaatctactgaaattagcaatgtaattttggtattataatgaggttggttcgaccttttgagcgtgggtaaacttgctccgttgggagtattgaccacgaagctaccacttcaacgaagtaagtggtagtagttcacgtccatatattctttaccactaattttttctttatcaggagaaaatattgtttgagctgtaaggatctctgtatttgctacatctaatattttttcattattaacatgaattactgttttgtctttagtataatctaccttagcatctcctttataaacagttatatcgtctttgtatactttttgtgtttctttactaggtttttgattttctttattctcttctactttttcttgtgtattttgaacagcttttgtatctttggatttattaaggcccaccgctattccacctactataactacacaagcaataattattgctgttatcttctttttattcatataattacctccaaattatgtttatatttatatattttttctatttttagtaatgtttatattataataataatttaaaagtattgtttgtacaataaagaacaaatatataccatatacttacaaaaccatatttcattcaaactcccccttaaattttagctaaaagccttaattaactaaataattattattgcaaaaaataaaaaaccatctgaaaataattttaaaattactttcagatggttttttagatacttaccctataaaataatcatatctttacatacatataatatagtaaagaatattaatataatactaacaaattgcatattttcattcaactaccaatactattaaattgcatgctgatataaaaataaatctagcaaaaactatacctagaaattataaagccatagaaattcctagacatactgcagaaactaataaccatgctccagctgacataataattcactcccaaatcaaaattttatttatatcattacctaaattaaaaaaattattcaggaggtccttaaagatgcgcgaaatttttaaaattatatttttctttatagcaatttatgcaagcgtcaaaatgtggtgtaaaataattaaagatattagggggaatgtttgatggttataaatttatctaaaccaagattatacttacaaaataaattagatgaagctatatttaattataaaatgaataatgctatttcaaagcaacaaaagattaaaacatttgtagatacaacagcaactacattaactgttaccttgttatttaatacatcagttagtgcagtaggctttgataaaataacaggagccttaaacccactcattgatttaattcaggccttaggctatccattagctgtattatcaatgagtggtggtgccataactatgatgttcaataagcgaatgggagtaagaataataaaagatactgcagttgcatatttagttctacaatttgtaccaggactaatgaagatattaatggatataggaaaagcaataagatgattattgaagttattccagacataaatataaataattctaaactatatagctttcttacaaatatacattcatataaaaatctatttaatagaattaatcttaaagaaaagaaaataacacatcaagataaaattatatatgaaattttactaactaaagaaaacatatctttttattatataatcccagatagcttaaaagaattagtacttaacgaattaaatgtatgttatcccaaagctacatttaaatctaagaatacttatagaacatataaagaagaaggtatccttaattttataaaagaggaccatatgatagatgtccatgttgcagatgaacttgaattagatcaacatagttttttaagtttaaaaacagatttgagatcagaatatcctcttaattcattattggaaacttctaaaattctaagagatgatgaaaaagtgttaatgcaatatatattggtacctgaagacccttctttaaatttagactttgaagaagccattaaagaatttaacactgaaaaaaagattaagagtaaatacaaattagataaagaaagaataataaaaggtggacttaaattagcttatgaatgtgttgctgaagtcatggatttagctagtttattttttacagatgaagaatttgaaagaattgatttagatgaattggataataatgtgctcgttcgaaatggattatctcaacaaaccaaagataaaacttcttctgtttattatgatacatctataagaatagctactaatagtgagagaagtgaattaatattaaagttatttaaaagaggctttaatctattagaaggtgataataaattagttactagaaaattaaagcaaaatgaacttatagaagcaataaaacaacgaaagcctatagataaaataaatatggatgcattaagcactaaagaattagcacagcttatgcaattacctacaaaacattaccagcaagaatacaaaattaagaacatagatactagagaaattaatataccacatgtttttacatcgaaaggattgcaaataggccatactaaatacaaaggtaataaaataccattattctttccactggatgatttagattctctatgccaatgttggatttctataggcaagatggggagcggtaaaactacttgcggacaaaatactgcaatacagctacttcaaaatggaattagtgtatttgctatagatgtagcagatggtgacttaataaataacatagagaaaggcttaccaaaagattttaataaaattatagatttagattttggagatataaataatcctatatctttaacatggagtgaatgtgctaatggagataaaaatgtagaaaccaagttagcttctcaacttaaaaactttcttaataaattggccaaaagtgataatcaaaaattaagtagcagaatggaaaggtttctaggtgccgctgccaaagctgtatttaaaaatccaactgctaatctatatgatgtcattctctgtcttactgatagggaatatagagataatttaattgtaactaataatattaatggtagattaaaatggaccttagagcaattaaatgatgatggaaatgaaaccggtacaaaacaaaactatgtatctggaataatggataggttagaatctttactggataatgagtttgcagctaactgtttattacaagaagctaatttagatatagactttaggaaatgggcagatgagggttactttgtaggcataagaattcctaaggatactttattagatgataccacagacttattagttacttatatagtaagtaaattatggcttgctatattaactagaagtaatatacctaaagagcaaagaaagccttgcattctaattttagatgaacctcatcaatttcctacagtacttacagagctgcactcaattataagagaaatgaggaaatggaggtttggcatatttatattagcacatgagtttggagattttaaaaatatgaaaacattacttaagagtgcaggcaccaattattttatatatcaaacttctaaagaaacatataaagaattattggaagaacttcagccatttacactcgaagaaatgattaatactaaatggaggcatgctattgttaatatgagatataaagaagaaaagatttgtgttatgacagatatgttaaagcctttgccacataaaagaacatataaaaatagaaatgtttttggtagatctgcagaaaaagtccaggatgaaatatttaaaaaatctatgcattttgaagatgaatttataaataatatgaatgatgataaagaaaaagaagaaaatgttcaacaaaaagctattatttaagattaattaacctatagaataaggtatagaacaacctatagaatagatgtagaatagatgtagaattttaaaaatacaaaagagcttataagtggcttgaaataaacattttacacaagattataaattgataaacccttatatatattatatatagttaaaaaagggtaggtgaggtattttgattttgtcggagcgggattggaaatttttaaaggacttatatttcgtaaaaatcttaaatactaaaagaatatgtagattatataattcacaaaaatattgttatgcacgtctaaaacttttgaaagataataattatatcaaaattttatataagcttcctaataaagaaaatgtttttactttagataaagaaggctataaaattttaggttataagccaataaaaattaatgctagtccacaaaaattattaccactagctgatttttatttctatgaaaaaagactagatccatttattaaatttgataataaatattattttagttattggaacagaaaatatattttaaaaatagatgtgctcttaaaaactaatacatggatatttgcaatattaaataataaacatctagaagagcaaataaaaaaaatagaaatgtattataaaagtaatcaatataaaaatttatttgatagattccctatagtcgttataataggtgatactacaaataaaattactgaaaataaaaatattaattgccaatggttagaatatgaaaaggttaaagaatgggactataaatattaacagtatatttataatatattacttattaatttttgcaataaacatctcagtatatgttaggaccatactgaggtgttgacttattaagttttattttaattaatatttcatacaccagatagaaccttgtataataatatcattaaggtcctagtgtatttataatattttttcgccctattttaaaaccacttttaaattaattaaaattagataatttccatattataaataactttaaatagctatctcactttaatcagaaaaatatcttgataaaaagttagacttcctttttttttaaacttagataataattgatcatacttttcataaaagctattcccaattttataaataaaagattttccttttacctctgctattttttctaaagattcttctactatattatctaaatcattatctttagaagataatgtaaactgttgctcgtttataactaacttatatctatattctttatagcttgtactaatatttttaaagtatttcttaaatatcttccaagagttttttaaggcaatagaaatactacatttagattttctcacaattttccatgctttattcattacgtctccagcacagcttaattgccaatagcctaaatctatttttaacataaaactatcgccccttataatttattaatagcaggaatttatttccaactatttacatatattatatatgaagcttaattttatttcaagatgtttaaaatattttatatataaattaacatcagctcttaatttagtaaactgatgttaaaatatgaatattatcttttaagtaaactatagatatccttttcatttaatttaaatattctttttacttcttccccacatttaatcatatcttggaaacttttatatttaatacttaattttgaattatcttttaatgagatgttttttaccatagttgaatctacctacctcttataataataaagaaaatcaaattgttctatatatgttaccattcatcactcttactacggaatattcatattaaaacctttataaattatatatattagttcatttattatattctttatatttttctgcaagctcttctttgtaccaatctgcaaagcaatcccctttctcatctttatctattgtatctaatggagttagttttatcggctttatattatcaataccaaaaaatttctccatagtgttggtacttgctttatccattattttttcaccccatcatctttcttatattttcctctcatttcgttacatatctcatcttcctctggagtagattgatagtttttatcataataatcatagacttcttttctcttttttgaatcaaaaatcatatctagtaaagaacaagattttaaaagttctttacctctagctaactttgcttctacatctatatcctcaatttctattttatcatcatcaccttcttcaaaaaacatatctaagtatctatcatcatcgtataataactcttctttaatcttcattctttcttcctttgttagggtttcttttggttttatttcttttttataatcaaaaatattaataactttactcataattatcactccatttttacgaatcagctaatttctttaacgctttagcatatttcttattgcacttttttattgctaaaagcacatctttagtatttgccactttataatttgtttctgtcttcctttcctctatttgcttactttttttgagatagtactttttcttattaccattccatctttttatattcacaacttttctcctaagattttcaaattatttcaaattatttttgcatggttttttatataaattagcgattcttttacatgcatctaaatcttctttagtcaaacttggagtttccaactttttaactatactattgaaatcaccttttgacactgtaaattcaaatatattattgcttctataaacttttgtcatgaccttatctcctcacattctgtgaaatagttatataaagacttttcatttattggttttacaaatcttagaaatacgtctctttcttcttcatattcttcttgagaaagggtgcttttagctacttttgtattaaaaaaagattgtttgttcttattcttttttcttataaattctaatgttaccatagaaactctctccctttttcattactatgtctattttaagcttatttcaagataattcccttccttctgaaatactaatatattattaattattatacaaggaaactgaatttaaaacgtcttttcaaggtgattttatatttaacttgtataagttgccgttctataggcatttctatataagcatctatcttttcttttagttctttataattattatttcaaaataaaaaacatagtatattaaaaaaacatactatgttaagaaaattactattaattgtagttctatatttgaattacattacaactatttttagattttcttctatatcaaattttttctttttttattaaatcgtctcttaacctagttaatactattcctaaccagttagtacctagccactgattactgtcccaagctctaggatcttcttcagaaaggccaattccccatatcttatcataaggacttgtttctacaagaataagtcctttagcctctattagatactttttcaatgcaggattttgattaaacttataataatttcctttgtatactattctttttaagccttttaaattttccagcttcaatatattctttgattttttttctaagtttttgttcatcctgtgtttttaaaatattcgtaaactttgtttttttgtatctagccataaataccaaatatatcctaaaaatccatagctatcataataaaactcaaaagtatatattttcttgctatacctatcttttattttaatctcaagttttgggttaatacaatagcctattatcccatcaaaatttgttaatccttttccctcaattttgctaaaattaataatttcatatcctttagggcaaatctcttcaaaaagaatttgaatattcctttctatttccataaaacacttctcctattttacatattattaatcataatcttcagcaaggtttacttcctcagtatctgtaattctaataaccttatcttcttctattttactatagactttagcatagattatagccacatcttctatactggcaccatgaatacaaagactttctattacttctccaatacatatttcatttgcatgatattcctcaataatggcatctactatatcatcaatttcagacttacaatcaatagtagttccttcatataatctttctataaatacttcatttgacaacatttttcattcctccaattttttagctttaaagtaaagcaataatttatattttaaatagttattattactttttaaaaacttataaataaagagcctaagattaactttatatataaaaaaattaacaccagctccctaattcagtaagctgatgttaaagtgtagatttcatctaatcaatattcttattttaagaacatacaaggtcgagtttgtatgagattctcaaaatgctctaaattcccttttgttaagtttttttcatctatataaaagttctcattattcatattatcaaagatggacatttgattattttgttttttaattttataattcattcccatagcatataaatccttagctaatcctttattaaacattaaaaactcatattgctttgggctaaaggcctttaaccattttagataatttctcttggcatttaataagcagcaccaacatccagttctaggttcatatatgactttcccatcatcatctaacaatttcttatcatatatttcgttataaggaatatttttttctttgacataatcaattaccatactattggtccaaaataaaattggattaactctaaataagttccaactactagcaaaatagaataccccatctcgtttaccagcattaagcctagcacgagattcatcagctctaactcctgcaacatcagaatcatattttcgttctgtaattaaattatgcattggtagatgcttaataaaatagcagcattgttcactagcactaactcttttaccagttgttttatttatagttctatcccccttatcttgaaaattccatccattttccttttgtaattcccaataagtttttgccggaagtgtctcaactacattagttagatcccactcttttattatcttatttttaaattttatagtatcattatattctactaaagagttgttaaatacaatatcatagttatcttttttcacttttcttaaaagatatagtgatagtatgctatccattccaaaagaacaacttaaagctaaatttttactaagtcttaatgtttttttcattatgtaaagactttgcaattcagctaatttgattgttattttagcctttctttctagctgtctatctttatgagctaaattttttattaactgtaatccatgtgtagaaagttcttttctaggatataaccctcttattgcatttatgtctttatttcttaccttttcttttcctgctaatgttatttttatatcttctgataatgcaataacaaaatcttgtagttcttgtggactttctggtatagttaaaattttgttatatatttctttttttactctttttttattctctattccattaattttaattattatattaatttctttatcagataattttttgattataaagttatctggctttattaaattctcttttaaaacattaaattgatttaaatatttttcccttataattttttcatttgatggatctaacgactgcaattcaatataattaagtaaatctatacccttaagtcttggattctttttaattttattatattgtttatctctatatactatcccttcatactcaaaagtatctggggtaaagacataagagtccttcccataataatttaattgattatcttctaattttaaatcatctgcataataagcaaaaatatcatacatctctggaggttgaacagtatgtctaactccatattcagtatcttcttcaaacatagttcctattatgtcctctatttgtactatagggaattcttcttgatttttaagcgcatttacaatattatttttattaaagtcacacatatcttcttcctggcaaccatagacactacaccaaatatcctctttttgatattgttttaagagtattgtcgcaagcatttctaatattattccattttgattataatttttatattctattttttgttttagctttattatgtcattaggatattgatcttttattaaataaaatattaaattcagctcttttttatcctttatagaagataaaaaattatagcactcatcataagtaccactaatccaataagtgcacatatgataatcattatccatttcacacatttctaatatcatttctccctcggttgttagatcatttatactatcaattataaaatcatctaatcttctcttaacttcttctaataaacaattagcatcttgctcattttctttaaatttaattacctctgctaacattaatagttttcccccttattttagctttaagccattaatattttcatatcaatttattatttcaaaataaaaacagtaaaaattattgatatatcttcaaataatttttactgttcattgctctaatatcttttatattttctaattttttagctttggaccattatttaaaatttaactctgtaccatattttggatcatattgcggcattaatattgcacacaatagatataaaattcctcctatgcctcttaacaatatagcagcacaccatattagcctaagagttgtagcatctatatccaaatattctgctattcctccacatactccatatatttttttgttatttgatttcataaacttttttttcattatataaaatcctccctttaatctattagctcatttacaagccatatttaccatctagttagttattattactttttaaaaaaatagaagaactatcttaatataaaactaagatagttctttatgtttaaataaaactaaacatatttaattgttcaaaaataacttttgaatctactttcttgctattcacatactcattaatattgcaaactttacctgggaatcccaattctttttctgattctatagataaaattctttcttcagtttttcttacagttactattctagcatttacacctgtagatctatcactttctaaaaaacttccagaaggcagttttttagcgaaactttcttcctgattttctaaccattctctaaatttttgtgacttcttatcagatgcaaaaaaaggatgttcactcataatagcaactacttttccacctggttttaacaaagaaaatgcatgtaatacatgttctatatcttgatttctttcaaatggaggattcattattattttgtcatattcttctactattatagaatcattattatcattttcttttaaattcacacttaagaagtcatcagctattacattatgccctttcttttctaaaatttgggataaagaataattaaattctactacatctaatttattatctggatatttttctctaatcaaatctgctatatgtccactccctgctgatggctcaagaattatatcattttcttttatatcagcatgctggagcatttcccctactatattctgaggagtaggaaaatatcctggtattttaactcctataatacttctttgcatttctttaatttcttttttctttctatcttcttctgtttcttcaaaaatttcttctctactattatagtactctcttaaagctgctctaagcattacagtatcttttatatctatcgcttgaagccttttataattatctatatcagaagtattaaaatattcaaactgaccattttgtttacctcttgaatacaaatctattatatcttctgtataatttttagtattaatttcagatgcatcattctttaataatttatttagtcttcttcttatcattactgtgttacttacagtagtagtatcttcaataagtcttttaatgaaatttttactacaagtagttaatggatattctgctacatctattgaatcaaataaaatatttgaagaatttctcaactccttttcatattgtatagctttattagaagagagattttcatttggatatttttctttaacttttatacttatatattttcttttacaacctttaagtatatcttctaaagtttgaatatgagttctagcagatatcttatttaaatatttagcttttccactttctataatatcagcaacattatacattatagattgtatattttttaaatactctccttctctttcagcattagcagccatattagcacgcctcgctgtatttgtaagcctatcagcaagcttattatctatttccttttgcatattgtctgctactttttttaatttttctgctgctttatcattctgatttacttccttagttccttctgttttaaatatatcttttagcttttctgaaggatcaaaataaaaattgaaacccctagtaaatctagaatagcctgctccaccaaggtttttcatttgtctattaagtgatttaaaatcatcacttttttcctcaaattttacaacccataaatctctattatctcttgtatcttttgttttttttattgaataagttccattggaaataaccttttgagttaatttaacttcttgttcttttagcttttctttttcttctgaagcttttaattcctcataagttctctgttcttctatagttagctttctcattcttctggcactttcaaaatcttgcaatgtttcgggattttttatactttcctttaatctcttaattttttccctgtacacttcatatttttcttttcttccttttaatagatcttttaatctttcttctgttaattgaacaaaagccgtatttattttattagacatttgttgtttaattgaagaagcattaaaatctatagtaatcattatagaatcttcgcctgaaataaaataataaatattgtctacttgcgagctatatatatgatctacaatctcgtctttcctagtatatctagaatcactaatcatttttttaagttctgctacttttaattttcttaaattctctttaataatattttcattgtttaaaatatactgaatcatgtctttaacataatccaatgtcatatcttctccttttccaaacttatcattaaaatcacctatttcttctaatgaatacattattattttcccccttaaattttagctgtaatttagccataaactattgtttaactaattattattactttactaaactctttaagggaaatatgaaatcatataaaataaattatccattacttgatactagtacatagtatataatatacatatagacattaatccttctatttcattttaaatacacaaatgataaaagtagcaagactatttaatttaagtcttgctacttttttctttaactgttataaagttagcatatttttttaacatgcatatatccatttattatcttttttctttaaatatataccgcaactaattttagagttaataagtaaaatagttttattttctcgatttctttctaaatgccatagtttattacaatgcggacacctaaaaagctcttctgatctaccaaataaattaggtgttatttcatatctatgaccacatgtgcatgttaatataggtttatcatcttccatttctaatccaaattcaattctataagtaaatttactcattaaattttatctcctctattttttaataatttcttagttttttgaattaattactttagaaaactaatggaatgcttatccttccattctattttttttatttcttcttttgtatagttaaattcttgaacctcacacgactaaagtcgcgtgattctttatacgttgtttggtatttaagtttccacgtattactacgccacccttaaacgtattggattgtccaaaaatccattatccattatctttattaaagactttggagtacattttaaatactttctcataatattataactaccattgacatcagcatttattaaaatacctttattacttttaaacaaacctctatatattcttctgttcttattatatttatctttacctatttcttctaaatctaaaacactacaaccacttgtatatgattcattttgtattactactttaattcctaataatttagctttatacttaatcttttctactaattgttgttgtggtgtttgtacaaatgatttagcagtattctcttgtttaattcctttgaaatcacctattacaatagtatgacatctattaataatagctaaatctatgattttcttacttgatttatgaatataatctttaatgaaattatttctttttgtttgtaatttaattaattgttgtgttcttttaaaatatttactatttttgtattgtttcattacgatagaagttaatctagctatttctttataatagtaactatttttagatttaacatatttaccatcaataatataagaatgtatattatcctcaaatgttatagtagctaaattattcaatcctaaatcaatgctcataatattataataatctttagctatatttacttcttctttagcccatataatatttaaattccattgttttttagaattattccattgtattttgatttgtttaatggttattaaatctacaggtattttgattttagacaaatcaaaatttaaactttgaacctgaaatttatttttaatttcttttgatagagataatttaagtatattatcttgcaatcttatagcatgttgagtaaatataatttcattctttttattatttgtatttttaaatttaggttgtcttggttgtcctaaatatttattaggattttttttataatctttaatgctagcaaaataggacttccaattcttttctaatatctttagacattgttgataattatgactgtgtaaaaattgcttgtgataattattattatatattttattcatttctacataagatttgaccgtatcttctctacaatcatagtttgctatattatataatttagtagtatgataagataactcttattatattcaattgttgttgatttaatttaggataatatttaaaacttaatttcacgattttttcacctcgctttctataatttaattttatgaaattaaattatagatcaaacacttttgggaattcatcccatgactaaagtcacgggtgttcttgctaaattcataaaatcctccctttaatctattagcttgtttgaaagccatatttactgtatagttagttattattactttttaaaaaaataaaagaactatcttaatacaaaactaagatagttctttatgtttagataaaactaaacatatttaattgttcgatagtgtttttataagtttcacaatttatgtaaattatgaagcctacttgatataatatgccattttaaaaatttctagggtttaagcttagtgccttttctagttaagataaaaagcttcttctaaagggaaacctacattcataaacattatctataataatcaaatgctgtccatgatagtccaataatgtcatatccggttgaaccaactggtgaattcactttacaacttaaatcagcaacccagttatgaccatttgcatatactttataatcatagaataataattgatccgcatttttaggtactgtagttatagcagaataagatgttccaggtccctttcgtacctttacattagaagttgctttataaaatctgtttgaagtactttttcgtaaatatgaactttttatatatcctgtttttacgcttccggatttaaccatatctaccttactccaacctccagatgtttctttaacttgtccagtatctattgctgtgtattttggaactactccatatgattcataagatgttccaggtccttttcttatatttacatcagaagttgtaatgtaaattgtaaaagtggaacctgttgaatatgcatatgctttatcactttgcattccaacaatccctatgaatgttaataaaaaaacaatcatacaaagtttttttaaacttcttgaaaaaattttcatgaaatccccccctaataattactcaacttcaaattaatgttaacacattttcctatttatgtcaatgccttctatttaacaaatcatgcggaattctcccacttctaaagtggaagatggatagcatttgacattagtcaacactaaatataaaatataatcagtagtaaataataaatatgaggtaatgcaatgatattagatacaaataatcattcagtattcaaacttaattatcatttagtattggttataaaatatagaagaaaagttataaatgatgagatatcaaatagattaaaagagatatttgaatatgtatcaccaaaatataatgtaaagttagaagaatggaatcacgatgttgaccatgttcatttattattcagtggagcaccaaacacagaaatatctaaatttcttaatgcttataaaagtgcaagtagtaggcttataaaaaaagaatttccaattataaaaaaatcattatggaaagaatatttttggagtagaagctattgcttaataactacaggtggagctccgatggaagtaattagaaaatatatagaaaatcaaggagtaagaaaatgttaaaagcatataaatataggatttatcctgataaagaacaaaaactatatttatctaaaacatttggttgtacaaggtttatttataatcaaatgttggcaaacagaattgacgtttatgaaactcacaaagataatctaacttcaaaagagatgtctaagctatatctaacccctgcaaaattcaaaaaagagtttgagtttttaaaagaagtagatagtttagctttagctaacgctcaaatgaatttagataaggcttataagaatttcttccgagataaatcagtaggatttcctaaattcaaatcaaagaaaagtaattatcatagttatacaactaataatcaaaatggaactatcttcattgataatggaagaattaaaattccaaaattaaaatcaatgattaaaattaagtttcatagacaattcaattggattataaaaaattgtactgtttctaagactccaagcaataaatactatatatcaattttagttgacactgaaaacattcaattacctaaaattgagaagaaaattggtgttgatgtaggattaaaagaatttgctatttgtagtgatggatatagagttcagaatccaaaacatcttagaaagttagagaaaagacttgctaagctacaaaaagacttatcaaggaaacaaaaaggtagcaataatagatataaagcaaggttaaaagtagctaatttacatgaaaaaatagttaatcaaagaaaagattttttacataagctctcaatgcaaattattagtgagaatcaagcaatagttattgaggatcttaaagttagtaatatgataaaaaatcataaattagctaaaataattagtgaagctagctggtatgaatttagaacaatgttagaatataaagctaattggtatggaagaaacattgtagttgcccctagtaactatgctagttctcaattatgttcttgttgtggatataaaaatatagaagtaaaaaatctagcacttagagaatggaattgtccgaactgtggtacacatcacgatagagatataaatgctagtaaaaacttagaaaaactaatagcctaaataggtataaatgaggttggaacgaccttattagcttggttaaacttgttccaatagaaatattgaccaagaagctcacgtttctataagcgagagtagttcacgaacaacaaaaatgatttattaaaaattactgaaaaagaacgaaagctaaattcattatgcttagatttcatccttgataataatgataattttagaaaagaacaaaaggatataattatcaagtctgatatattaacattaaatgatgtattaaaagaaagcggtaactatagcacttcagaaactttttgttttatagattaatgtgtaaaaccactgtgccttgtgcctgtggatgtaagcattttcaagggaataagttcgatacttattcccttaaactatatattcttttggttttgaatatacttcactattatttcagaacttactgctccagcagttccaacataataacctttgctccacaatccactaccccaaaatttacttccctttaactttggaaatgctttaaatatctcattagcacttacactctttaatatcttaactatttcagtaggtgctattgttggtggagcagatataaacaagtgaatatggtctggcattatttcttgttctaatacctcaaaaccgtaattaaaagctatgcttttaaacgtcttcgatatttcatattctaagtcatctttgaaaatgttgtgcctatatttaggacaaaatactatatgatagttaatgttatagacactatgacttgtttttcttactttctctttcaaggatatatttcattccttcctcaatcaaatcattagcattaatacctttttgtagtgccaacattcttatttctttgtataaatcttcatctattgtagtattaatattttttcttgccatttaatttcacctcatatgtattattttaataatattatactacattgttgacaatgtatcaatgttaatgtagtattatatacatagataacaatgtgaggaggtgaaaaaatgaagttaagttttaaatttagacctaatattgatccaaagcaattagagattatagaagaattaagctatcatacaactaaactctataatataatcagctatgacctaagagagaatggttttaaaaattattatgaaattgaaaagttatataaaaataattggcattgtgattttttacatagtcatactagacaacaaatgtttaagattttagaacagaattggaaaagttattttgctagtattaaagattttgcagttaatcctagtaaatacaaaggattaccaagacctcctaaatttaaaaatacagaaagaaacaagaatgaaattatatttactaatttagctataagatttcaagatggaattttaaaattatcattatcaaaatctattcagaaactatttgaggtagatagtcttaattttaaagtttcaaataaacttcaaagccttataaattggaatagattacaacaagctagatttaattatgataaagtgcaaaaatgttggtatttaatcgttatctacaataaaaatgaagttgaaaatagcaatgataatgttatgagtattgatattggcttagataatttagctactataacctttaaaaatggaattaaccaatatgtctattgtggcaagaaattaaaatccgtaaactcttatgctaataagagaatagcttatttacaagttatcgaaatgaaaaaatatggttctgataaattcaaggacactaaagaaataaatagacttaggaaatatagaaataactatattaatgattatcttcataaggttagcaagaatataatagataaggctattaaaaataatgtaggtaaaattgttataggaaaattaaaagatataaagcaagatatgaattataataagtcttttgtacaaataccgatacaacgattagttgagttaataacttataaagctaaactgaaaggtattgaaattaaattgcaggaagaaagctatacaagtggttgtagtgccatagatttagagccagtaactaagaaatattataataagagtagaagaataacaagaggactttttaaaagcggatatggaatattaaatgcagatattaacggtagcttaaatatattaagaaaagccgagaaatgtattcccgacttagtaaatgctatgagggataagggtaattggactcacccgcaacgaataaggattgcctgttaaggtggaaacttaattatcaaacttcgttaaaagaatcctcgtggtcttgtacccgaggtagttcaatgacctaaccaatcctaataatagattagaaatttgttattatatagactcagaaaatgaaaattgatatagtgcagaaagaataatagtttataaagaaaatgttaaagtccaaagtatatatactggacaattacaagaaaatattaatgcttatgagattataaaaaaacatctaagtagcaatttttattgcaaaataacaacaaaaaaatttgaataacattgagataaagattaatcatggaaggtattgccccttcatttctcttaaataaaaaagagcaggtgttaatttaaaacacatgctcttttttatattcattttgtccaataaagaaacaaattttacttctattttttaatatttttatttgtatctttattttttataatatcaccaatagctgcaatatttcccaatgaagataatgtttcatttggaagtattaatttattggctggacccttggccatctcttttaatgcttctacttgttttaatgcaataacagtttcattagtccctgattctattatagaagcattaacattccttatagcatctgcttctgctttagctatttgtgatattgcctttgccttacctgcagcttttaataattgagattctcttaatccttctgctctccttatattagcttctttctctgcttctgcatttagaatagcagattcctttaacccttctgctttatatatagcagcttgtttttcaccttctgattgtagtatcatagctcttttatctctttcagcttttaattgtttttccatagatgctaaaatatcacgtggtggtactattcccttaacttctacactaaacacttttataccatacgcatctgttacctcatctataataactagtaattttttatttatttcttttctaccagttgatagtatctcatctaaagtcatatttccaacaatatttctcatatttgttatagatgaatatactatccctgcttgataattttctatattatatactgctgctttgggatctaatatcttataaaaaattacattatctatagatatattaacattgtcttttgttataacactttgaggctctatatctaatatctgctgcttagtggatattctttgcctaacaaaatcaacatatggtattataatatgccaccctggttctaatgttctatgatactttcctagtctttccacaacatatacgtagcctgtattcactatctttattgatgctattattgttgttatcaataaaaataatataaaaattataaataaaatcttcatataaaaaacctcctgtttattttatagtaattatatatacaatttttctttttttaatttttatttgtaaaataaaaaagaattgggattttttcaattccaattcttaaaggttttttataattttaaattaattgtattgcgaattaatgcaatattattgattgtattataatattctttttcactattaaagctttccatagcagatacttctgatatatcagctcttattgtatatccacatataggacatacttttaaaaatattatcttattgtttcttttattttccttagttctagtaaacattttttctccacaatgtttacaaaaatctctatttttcatttctttatttcccccttaaattttagcaaatagccatatgtatattacatatatttattattcctaatttaaaaatttaatgcataaaagcattaaatttttgttctttaatccttttactacgtttgattcttttttctatgtatttatatacagaaaaatttgtatgtattataaagttattattatatttttaatttacattttgttagtatacataatatataatatgcatacttacttttcatcatttacatataaatgataataactagtaaaaaaatatattttgttaggaaattttataattaaatattttaatgcttgtttaatttatcccaattgtagccaatgatattgataattatatagtttgataatttcgaataagagttggtaaaacatatcataaataaatggagttattaccgaatttttaataagaaagtatataaattgctatttgaaatcatatatatggtaggtacgttatttatatttagataataaaaatatttataattaaattattgtttaaggtaattttccctattaaatcatatatacattaaaaattttgttaaactttgttataattattataataagttatattatgtatagatttaatgggggaaaatagatgaatagaagtgcatattttaattatatagaggaaaatttgaatgtactttcatatagagtaaatgcaagaggaaaactaaatatattggatttaaatttgcattgtgaaaatttttatatggatttattaaatttaatttatggattatgcttagaaaatttaaatacaattaaccaaaatattgagggtattgacttaatagataatgttaataaattgataatacaagtttcatctacttcaactaaacaaaaaatagaaagcacattatctaaggagatatttaaaaaatataatgaatacagttttaaatttatctcaatatctaaaccagccgacaatttgcggaaaaatagctttaaaaacccatacaatataaattttaatgctgaaaatgatatatacgatattcctgtaattttaagacatatatcttctttaggaattgataaacaaaaagaattatatgaatttataaagagagaattaggtagagaagtagatactataagagtgtactctgatctagcaatgattataaatatactatctaaggaaaatttaagtaatattcaacaagatattaatgtaaatagctttgaaatccagaaaaaaataggattcaatcaattagatatgacagagatgatgataaatgactataagatatattataatcatttagaaaaaaagtataacgaatttgataagcagggcgtaaacaaaagtttttcagttctccaagccataagaactcaatatatgaaattatgcataaagaataattatgataataatgatatgctattcttgaatataatagaaaatgttagaaaaataattttagaaagcgataattatataaatattccttttgaggaattagaaatgtgtgtatgtataatagttgttgatgcttttataagatgtaaaattttcaaaaatccggagggttataattatgttactgccagataatatgcagccagaaatgagtatatattataatggtgctattgtattatcttgcttgaaaaaaaattcaaagcaagacttaatggaactatataaaaatgtaaaattagaacgtaatattacattttcagtttttttgttatctttggactggttgtacttaatagatttagctaaatatactgatagaggtgagatagaactatgtttataaaatcactaaaaatatctagtggagatattatcataagagaaatgctgtttaaaaagggaattaacttaatagttgatgaaactcctattatagatgataaaaatttagataatgaaaaaaaaaccgggaataatgttgggaaaacaacagttcttaaattaattgatttttgtttagggggaaatgctaaatctatatattctgatactgattccggtaagcaagtctataaattagtaaaagattatttagtagataacaatgtattaataacattagttttgacagaggatttagataataataatgcaaatgagattataatagagaggaactttttatcaagaaaaaagttaattagaagaataaatggcaatcaaaaaacagaagatgaatttgatttagagctgaaaaaattggtattaaacaatactaaagctaataagccttcctttaggcaaattatatcgcataatataagatacaaggataatagtatcaataatacattaaaaactttggataagtatacctcggacgcagaatatgaaacattatacttgtttttacttgggtgtgtatttgaagatggagaagaaaaacaacagattttagcaaaaataaagcaagagacttcatataaagatagattggaaaaacaccagactaaaactgcatatgaagcagctttatctttaattaatgatgatataaaggagcttaataataaaaaatcaaatctaaatataaatgaaaattttgaaaatgatttagaaaagttaaataatataaaatataaaattaataaattaagctcagaattaagtaatttaaatataagaagagaccttattttagaatcaagagaagagctaaacaaaaatatttctaatatagatttgcaacaacttaggttgttgtataaccaagcaattagtagaattgaaaatatacaaaaaacatttgaagatttagtaaattatcataatacaatgatatttgaaaaaattaaatttattgaaaaagacttacctttgctagaagaagaaataaaaaataagaattcagcactagaagagttacttaaagttgaaaaatatttatctaaaattatcgctaaaagcgattcttttaaagaactagaagaattaatgggggaaattaatgagagatatagacaaaaaggtgaatatgaaaatataattagtcaattaaaagaagtagaagataacatcgataaatataaaaaagaccttaataacatagatggtaaaatattttgtaatgattttgaagaaactgtaaaggaacagattaataaatttaataagtatttttcaagcgtttcaaacaatttgtatggcgaaaaatatgcaattaaatatgatataatagagaataaaaacaaacaaaaattatataaatttagttcatttaatacaaatcttagttcaggaaagaaacaaggagaaatattgtgctatgatatagcatatataatgtttgctgactctcaaggtatcccatgtttacattttcttttaaatgataaaaaagaattaatgcatgataatcaactgttaaaagtttcagattatataaaagataaaaatatacaacttgttatttcaattctaaaagataagttgccacaaaaactgaaggatgaaaaatattatgtagtaagcttatcacaagatgataaattatttaagattgaaaattctattttataaatagaaattgactatatattattaaaaagaacttttacttgcagaatgctacaagtaaaagttcttttagagttgggtaaaaattattcaatacataaaattttttaactatatctacgctttatattaatttttttatttttgcaataataattttatataaaaaacaatatcgtgaataacaactattgaaaggagaaatcttcattgtgaaaaattatcttaaaaattacgttaatcatataatatttatatgtattgcagtagaaatactctctttaataattttggtttcaagaaaatgttccattgaaaatattatattgttatatatcttgccatttatattagtattatttattaccattctaaataattttaaggatagtaataaatctaatattgatgataaatatgaattaattgataccttggatttataccattcaaaaaatcaatttattcaaaaaaaagaaattaataatgagattatatactgtttttcatgcatcgatagagaacaaaacatttctacagaaatcataaaagagaatactgaaaatcatgttatagtaaagaaaataaatcattataaagcctatgttgaaatttataagaacatatatgataaaaaaaatgtatacattatttatttaccaaagcgtcttgcacttacgtagaaaaactctccatatataatttgaattatatatggagagtttttctattaaacttattgttttttactgcaacacaagtcatttttaaatttgcactctgttagagcagtatatataggtgaagtattccagaatcctttatcagtagcggtttttctgttatatactgtttcacaatcatatatatacatgatgtcagaccatttagcattttccatttttctttctactttctttttattttttgtccaaaggatataatgtgaactaccaccacttatagaagatggtggcttcgtggtcaatatatctaacgatacaagttcacccacgctatcaagattattccaacctctctagtcaatatatcttttattatattgctagttttaataagtttttactcgcatttaagtccctatccattatcattccacatacaggacaaatataagttctacaagacaaatcttttgtttgatttgacttattaccacaactagaacataattgactactagcatagtttggtggtgcaactattatctttctgccatgccaatcagccttatattctagcattcttctaaattcataccatgatatttctgatattgcttttgctaatctatgattttttaacatattactaactttaagatcctcaataactattgcttgattctcgctaataatttgcattgagagcttatgtaaaaaatcttttctttgattaactattttttcatgcaaattagctacttttaaccttgctttttttctgttattgctccctttttgtttccttgataaatttttttgtaactttttaagtcttttttctgatttccttagccacttaggatttccgaaaaattctccatcacttgttatagcaaattcttttaatcccacatcaataccaactttcttatctgttttaggtaactgaatattttcagtatcaactaaaatagatatataatatttaccacttggtatttgtgaaatagtacaaaatttaaccaatccattgaattgtctatgttgttttattttaatcatagtttttaatttcggtattttaattttgctattttcaatatatatagtacctttttgattatttgttgtataactatgataattactcttcttacttttgaatttaggaaatccaatagatttatctctaaaaaaatttttataagccttatctaaatttaattgagcattggctaatgctaaactatcaacttcttttagccactcaaactcctttttatattgtgcaggtgtaggatatttactttgcttaatatctaaatctttgttttcttcgtaagacttaatcctgtccgctaacatcttattatatataaatctagtgcatccaaaagtttttgcaaaatatagcttttgttctttacttggataaatcctatatttatatgcttttaacattcacttccctccttgattctatatatatttcttttattgactaaattcaagagctattcgtctcccacctaagaggataggagaattacgcccgttaagttaaattcttttaatgtcatttctgattttaagcaatcattattacaaaaatactgcattccaccatctatacaatatccttctgtcataagctttccacaattagaacatattctcacttccatttcctgatgctctaataattcttttaacttttctttatccaaaattatattagccaatcttataaatttctttgttgtattggtattcattatttttcttccttcctcctaatcttagcttttatacgccatagctcattatttaattaattattattactttaaaaaaatttattataatttactcttgtaatattttaaggtatatattggtataatatataaagagttataaattttgtaatttataactcttccttaaattttagcttaaagccaaaagaaagagtattaattcaatactctttctttttttccattatatattgtccttatgtttaaatgaaggcaaatttaaaatcatttttaatatttattaagttgtcattatctatattattaattcctttactctcattgataacagctatagctgtatttagtgtagctataatatctatttttttaatgatatctatttctttattacttataatatcttttttaaaattatttatattattataatccatttctattagatgctttgtaatttgtttatttaagttcatatatataacctactttctcttgttttatacttaattattattactttttaaaaatttagttatattaataaaaattttatttaaaaattttaaataagatttttttaatcgctacattgaagtactgtttccacttctaaagcctatatctactttatgtaaatgcaactaaaaatttaattctatatagtggttgtcaattaattagtgtctaatacgataagaaataatataaaatttttatgtgaaaataggaaaatactactatttacttaacctgaaaaaattaattgcttgaaaatagatatattctttaagtaagatatggtataatatggttgaaattttatgcttattaataacttgcaaaaggatgagaaattaaatttattgaataatagtattttatataaatgaaaaatagacttttaaatatgtttgaaatagtagaaaaataaattatggattatagtaaaactataaagaaatattattatatataattaaatataaataattaaagattatacgagtaaattgagtataatagtaaaagtaagcattaaagcaagttataaatgtttatgaaagtatgggctatgataaatcttatttttactctaagcatgaaaatataagaaaaaaattatttagaactatataatgattctcgaattattaacaaataaaatagttatttaaataaaaactatagtaatttaataaaaattattatatattttatttaaaattttaatttataaaggtgatgtgtatgtttaaatatatagataaaaaaaaggaaatacttgatagtaaaagaccatttaataaaaattctattgaaaatttaaagaaatattttgatgtagaattgacatataactcaaatgctatcgaaggtaacactcttacaattacagaaactaaaattatcttagaggatggtatcactattggaaaaggaaagactcttaaggagcatcttgaagttattaatcataaggaagctattgattacattaaagatatagtaaataaaaatattgatattaatgaaaatgttataaaggatttacactatattattcttaaaagtataaacaatgaaaatgcaggtagatatagaagtgttaatgtgcttataagtggtagtaatcatagaccaccagagcattttttagtttcacaaaatatggaagaattgattaaatggtataatgaaaataaagataatttacatccggtaagacttgcagcagaatttcatcataaatttacttttatacatcctttcatagatggaaatggaagatgtggaagacttcttatgaatttaattcttatgagatttggatatccaatgactgttataaaaatacaagatagaagtgaatatatgagtgctcttgaaaaagcaagtgttgagaatgatttaacagattttataaacattattgctgaagctgtaagtagcagtttagatacatatttatatatattaggataggttaacaatatagttaagcagctttattaatgtgcaaaattcccccatcttctaaagtaggagatgggggaattttgcgcaaataagttaaaaaggtatatctccatcatctactggaattatatcatcgtcaaaactgtttccatttccaaaattttgtcctgattggtaacttgattctgatctattattatatgatgaatctgtggtagctttatctccccactcaagaaatttaacttcttcagctattacttctgttatatatctttttgtaccatctttggcttcatagcttcttgtttgtattctaccactaacccccataagttttcctttgctcatatagttagctgtagattctgcttgctttccccatactactataggaatgaaatctgcttctctctggccatcctttgaaaatcttctatctacagccaaagtgaaattagcaaccgctgttccatttcctggagtaaattttaattcaggatctttggttagtctacctattaaaacaactttattcatttttaattacctccgtaaattatatatattatagttgtaatctttttaagaatactttacaatgtcaattactcactgcctatagaggcgggagcttgtaactctactacacatggtgttaatgatacaaagtatctcccatctcaaacgtaggttacgatacggtgattgacaacaccgcaacatagtgagtttactcactatgttctttggagaattgttcaatatattcaagaccttttctccaaagatttattgatccaattctatcatcattagattgatagttgcaatttttacatttaaagatatgttttttcttatctctattagctttttcaatatgtccacatttggggcatgtttggcttgtatatttaggattaactgaaataactattgagttattcattttagccttatattcaagcagctgcctaaattgatagaaagtccaagatacagaaacatatctattgtttatatttactttttcagtagtatttctaacgttagttaaatcttcaagaacaaataatgtgtttgccccatatttatcaacgagtgcctttgtaatggtatgattaatatcattaacataacggttttctcttgaaccaatagatttaattttacgtcttgctgacttgctaccgcactgttgaagttgttttcttaatattttataatgacctcttttagcttttatatgtctaccattgtagaacgtggttttaccataactatcatagatagttgctaaaaaattaataccgaggtcaatacctactattttattaatttcaaaaggtgtagtttgagggtaatctttggtcattggaatatataagaagtatttgttaaacttaaatactaatttagcagtaccaaaactataagaaccatcaaaatatttttccatgcctttagtttcgtaaggtatcttaagtctaccttgtaaactatttatagagaatatatcacttttaatagagtaatctctattccatacaatgtcatattctaaatttttaaaatgcactaaagtaaaatcatgtccattggacttattggttttatatttagcaatagtagtttttatacaactttgagccatttgagattttaaaccatatgtttctcttaaataataataagtatcttcattaatctttttctgattaagacaattattattaaaaatatatttagatatataattcaatgcttttctaatttggaacattgtattatttaaaatatctatttgctcattagtaggatatatttgtattttagatgttatagtaatttctataatatcaactcctttcactattataattattatattagtgaataaaatacaataagaaagtgaggtgtaaagtggcaagctgtggtgttacctatcggcaagtggcaattcctcccccacttatagaagatgggagtatccttgccacgattgaatgaaaattatggccatttaaattagggcataattctttttatatttgtgtaatcccctaatggtgaaatctttactacatcccctgtgtgtggagcatgtatataatacccatttcccatatatatacctacatgagtagctggatatccatgaaaaaatactaaatctcctgcttttgcttgagataatggaacatctatgcctacttgctgttgttcctgagatattctaggtaatgaaataccatgtgcattataacaatataaaactaaacctgaacaatcaaagccttgtggagtagtacctccccaaacatatggtacccctaaaaatttagttgctaaattaactacagaattacctatatcatttttactattaactacaggtccagcttttaaaaaatcattatattcagcatgattttgttgagctattatactagttgtattgcttgcattattaattttagctttatttaattcttctaatttaacctttagctcctttttcttatcatctatagttttaatatcattctttatagaagaagtattcttttctatctcctttttatcttttgatagcttttcattagtttttattatatcttgtttatctttttctaacgttttaatagttgtattcccttcttctaacactattttcattattttggctttatttaagaaatcactcatgttttcagaagacaataacaaaactaaagcattgttagaattattatcattttctatataataatctctcatttgagcattcaacatattttctgtttcttttatctcttcttttttattctgtataaatttttcattttgtttaatttcgttaattaatttagagtttttgtctttattatcatttaatttgatagttaaattagataaatcattatccaatttctgtatctcaattgttaaatctttctctgttggagctgcattaacaattggatgataaaatcctataatgcttccccctatgatagcactacataatattattttcaatttattctttatcataaagatatctactcctatctatatatttaaattgtattttttagaatttaaattataatcaaaataagaggtgattataattggaagaaatatttaaaattaattatttgttaccatgcgattctagtagttcagaaggatactctaaaagtactactgtagaaaatgcaactgacaaattaaagctatatttatcaaataaatataatattgactttgcagatatagctattttatcctgcactccaatagaaataattcaataatacagatgagtaaaatccatctgtattatttcaatctctttatgtcagcttcggcctcttcaatttctaataccaatttcataaattctatattttcttttaactctggggtattgcttgaacatattataaaattatccaagcttgtgcttatattataattaaccaccattagatcattatcattaattcttaaatcatttaaattatcttttaaatggttaagttcactttgaattactttattatcatatattgttgattcagcaatacttatcaaaatagggattatagcattccttttttgatatatattctccagttgtttttgctttttacatttgtggttctctaaatattgcaacaatgtatggattatataaagtgaaaatattatcattaataatactgaatacataaaatcgtcctttctctagtatcataagtgacaatataataattttttataattattaccttgaatagtatattgataaggatattgtcttactcttttattagcatattttttaaagaattttttcgtctttgactttgatttttggtttttgataatcataatttatacctccaatgacattctttatataattatttatccattttaaaagttttggcttttataattctaggaggtaaaattattatttatattacgtgaaatacccttgctataatggctataatacaagataaaaaataatatataacaaaaggacattctttatttttacgtttaaatatataaggatctaaaaccgatagtaaaagacctattaaaatacctatatagctataaggatatataaacaaagtaatagcaggagctaatttaatatctcctccccctattcctatttcatcagtcattaatccatatactaattgcaagatatacataatagcaaataaccatattgaattaatcaatatatactttattggtatttttaataatattgctattaagaaagctaaaatatactctattaaacaggtcctatttaatacaattctttcttttatatctctaatagatgccttatataagataatcaaataaatattagtcaatataaataatataatattttttataaccatattttcctctcatctcccttcaatttttacatatgcaaaaaattaaattataaaaacacttttgtttaatttttttaattattgtatatataaaaagctgtaacttataaattaaagggggaacataaaggatgatcagtccaactataacaaaccaattcaataataatattgaaatatgtaaaacactaaagatactacaaacaataaaagaaaaagatataaatacttataatcacagtgttaatgtagcaaaacttacatatgattattgtgtatattatgatttagataataaaggtaatatttttttatcagcattgttgcacgataccggtaagatttttatagatcctgttatactaaataaaccagggaaattaacaaacatggaattttctaaaatacagcagcatccaattctaggatatgaatttctaaaacaacataatatgggtgaatacatatcgcaagctgcattattgcatcacatatatgaagacaataaaggaggttatcctaaatttaatatagcaaaaccagattatatacgtttaattagcatatgtgattcttttgaggtaatgacttgtaataataggctttatcaaaatagcattaacacatcaaaagctttagaagaaatagaaaataatatagggattcaatttaataatagaatagcagataagtttatatattggatcaaagatacacagtaacattactttaaattattttgtgctaccctttctacctaagggagtggtcctttcatacatttcttataatataaaaagagcaacagcacttatgactttaatcatgagtgttgttgctcttttacctttattggatattaattttttgtattttcatattattttcttttaatattttaataaagcctgcatttacggccttaattccattaattaatatttttctgtcattatcatttaatggtattatattaacagtaccattataataagatatttgtgaagatcgtaatccatttcctatatctataatataatcctttggagattccaataatgcattaataacatattgctttgattgttcaaatatattattaatatcattggcattgttcatatctgaacaattattagctactactggattagtattagtagatttgagaactttttttataatatcactaattttttcttcttctgttttatatcccactaattctattaccgctacttctaataaagttaagttattataagtatatttactatcattaattttctcttgtaatagctcaatatacttaattaagttttctttatgaacttgttttcctaagttaatcataacctgtttttcctcttctatagttgctatttcagtcttagggtttatagctaataccaaaacatttctaaaatatttctgcagatctttcattaattgatttgcatcttttttattctgcattacagctttatttataagctgtaatgcagatatagtatctttcttaataatgctaaaagctatatttcttatatcttcttctatcattattcctagtaatgtagtaacattactataagtaatctcttccatagttctaacctgatctaaaatacttatagcatctctcatagctccatcagctactatagaaatcaactttaagcttttattatctatttttatcttttcatgttcacaaatatatttcaacctattaaatatatctgtaacatctattcttttaaaatcaaatctttgacatctagataatacagtaataggcaacttctgtggatcagtagttgctaatataaatattacattcttaggcggctcttctaatacttttaaaaatgcgtttacagcacttatagacagcatatgaacttcatcgattataaatactctgtatttacattctgatggagcatattgagcctgttctataatattccttatatcttctattccattatgtgaagcggcatctaactctacaatatctatacaattacctgcatctattttttttgacaattcattatctagtggttctccatttttattgtgctgatttacagcttttgcgaaaattctagcggttgttgttttaccgctccctctgtttccacaaaataaataagcatgacctatatgtccagttcttatttgatttaataaaattttggtattttctccttgacctactacatccttaaaaaatcttggtctgtactttaaatataacatcttgaaattcctccctaattttagctctacattaagccatatattctatttaaataattattatttcaaaattttaaaataccttaacagcacttagtactgttaaggtatttttttttagatataggtataatatcttttttattgcaacgcaattgtcttgatagcatatctatatatagtaattttataacttcataatttgaatttgaatatataacatttttatattcaaatttaacatatattgttttatttaaagaaggcaaattatgaattttaaagtaaaaattgttcaataatgtcaactcctctaagcaactgttattgtaattgaactattattttttatttcttctttgcaattatcacaaacaataattccatcaattacattattattttttatttctatttttttattgcaaatgacgcatatattatttttacctttcaaaattaattcaccttcctgctttctttaatattttcattattaactgctcctaattacagaacagcttaaaacttaattcttctaatactatattaggattggaagaaaacttaattctggtttcatttcccataaatgcaattagacttttgtctaactcttcttttgtaaaattattagatgattcataaattagtttacaataataaggattcttacctgtaaacttaacaaaactatctaaactatggttgtttacttgaaacaatctagcttcttgtaacatttttatatgatttaacaatgtataaaatacactaacaggtttttcacctttatctaataagttcttaagtgtattaaaataaccattgacatctttcttactaatagaatctgttaaatcaaaaatatcatcatcattataagaagatatacagtttattatatcttctatattcaatgtatttttatttaaacataatagcttctttatttcttgcaaagctatatctatatttaaagttttattaacaaatagatctaacgcttcatttgtaatagtagtattgtgcctagcaaaaatactattgcaaactctttttacataatcagattgaaactccccatttataataaagaaatcatttttaataaatttctttatttctgagtttttattaatatttgttcttttatcttttatatatgaatataaaaaaacattagtttcgtctggaatactcttcaaagcttttaacaagccatttattttttttgctacccctgttttgaataaaggaagttccattaagataactctcttactatccataaatgggattgtatttattatttttttaaactcattttcctcttcaatcattttaaaatccattttattaatatttaattgtggatttataatttgtgaacatagtagttttttagttttattaaaagctgttacattatcagtaataagtaaaatcttattactgtttattgttttaatatttgttatattttccattttatttcccccaataatttataaactttctactaattttatataacgattttttaaaatttcatttcttgctataacatctaaatagttattacagcccttactttcttttaatttatataaatcaatattttccttctcagctagctgcttataaactttttgtcttaaggagctatagctaatattatatttttgagccattttacttattttctcattagtaatttctctccataattcttttttatatgaatcatgagtctttttattttcccattttttttgatagtatggtactaatattaaattagcatcttttacacttagccctaatttttttgatataaatataaatccttttgctgaaattaacacgtcatcttcttctaatttatcaccattcggtaggtccttaatatagttatcaattattagatagctatttacagggccttcttttattaaagatactacttctctatgatctaattgtatattgcaatgtttttttaacaacttagttattcctatcccattaatatacttttgttcatttctttttaaacatataatcattgtaactcctccttttattcttttagcttcaagccataataaagcttctttaaaattattattccaaaataaaaaaagttgcggttattccaataaccacaactttatatatacttttttattaaaatttattaacttattttctctatataatttcttctacattattaaaatctttattcgctaacaatctataatttttaaaaaatcctcctaaattatttcttatcagcttttcattttcttcccaggtatatcccaagggagataataagcattcatttcctaagaacaaatcagcttcataattagaggccagttgatatgctgttagcacatcgcttttaaatttaaatggtttctcatatgctttaattaatataaagacatatttttctttaaaagatttatgcattattctatctaataaagtattaatacctttttttactttatacttatatatatctttatacttatatatatttttgcatttaatattgatatattttagtagcggcatttcccattgtatatcaacatttttaagactatctaaatagccttttttgttataacttataattaatttgcctaagtaaatatttataacattagactcgcagctcaattctttttcccatttacataaacctaatcctgatattgaaaattgtagtccttcatattgtcctataaataatagaatcttttttcctatcactatttcctttacttccattccaaaatctttccactttaatattttcatatagcatcctcctagttttagcttttaaaagccataatttataatctaataaattattattactttatatttttttatttgatttatataatatagagctcgtaacaaaaaagagcactgatttcttaactatcagtaccctttctattaaataaccgtatcatctttttaatatcatttatgaaaatttcatttttccttctcttaatgttattggatttaatgtaattatagttttattttgctttttagcatattgtatacaattataagttccacccttacattttccattatatatagctataacataattagagcaatcaaccatatatctattccttacttgcaattttcttatattataggtgtctttctctattttgggtattttatatctatctagagcatccacataaactaattcatctgctaagttaagcattcttctgtatctttctctatctatatcgttccatttattaggttggtttttaaaaggtatcgctattatattctttatatatggataacggatcttcaaattttctactacaaaaaatgaaactgtatctcctccaagagctccccctgtaataaatgtatctatactatatctttctattagcataatacatatttctctaatctttttagctaataattgatacttcttattccttagctcataaccatataataaatgaggcctatgagctgtaaaacatactatcattatcacaaagccatcctttctttttataaaaaatgctaagttaattaacttagcatttacttatgtttatacttttatatctttggaaattcctccatacgttatttattttgtcttaaaaaacatatttatttcattttttttcttcttattgctaaaatatggtcagtcattcctattacagaagcttccaatgttatagtactgctaatcacttgagatgatttagaaactttagctaagagtattactgatgctacaaaaataaatgaccaacacaaaatcattacaatatgtttattaaatctcaaagacatattataccttcttccctaattttaatataaacacatattaaagttcttcctatttaaactactataaatactatctaattatttacactatatttcttgaatttcgtatcttaattaaaaatactttttaattcatctatgctttttgtagaaaatatagatataacctcatactgctaatcatattgaggcttttcattatttgttgttgtgtaatctaacatgatttcatgtacttgattccacctcatacccattaattctggtgcggtaagactaatactatttttaatatttaataattcattattaaaatccttattttctgataccctaatcatttcttctataacattttctaattttctcattctttattcctcctagtcgattaataaaaatttcaggccctgcagctgctctttgtaacatgacttaatctaatatcatttttttattaatttcacattctttatgataatttaataaatctaaatgatttactacgaatggtatattattcattaactctaaaatataaacaccttctcttttgtcgccaaacccattatattcaactaccttataataattgtttctaaattttactttacaatttaaatatattttatgtccgtttttatctaacactccaacatacttaatattttcagtatccatttgcataaatctcccttttacgcattaatttcaaattacgatttcgtcaaatttgaattgtgaactacattaatacttctaaatataatttctttccatttcagatttaaatacccaattgccaatatctccatcaaattaattaatcaaaacaatcatcatcaataaaaattgtttcatcttcattttcttctacgcatataaagaaaccatcttcaattcctataccttgttcataaatatcattaaattctattttacgatatttaacaagtcctaaatctacaagcatttttataaattcatttatactatcaactatttgtttttttaattcttcagttaacttttgtccttgccattcttctactttattaaataatttttcataatataaatcatttattttttgcacattatccattaaatatcctctccttatttgcaataatttcagatcctccaactgctttttcgattatgacctattttaataatttagcaagttcataaataatattatttagttttaatatctataattgcatataaaatatacgcatctattcctccacccataaatgcaataaagaatttccaatccgttacttgcttataaattctccaagtaacatatgcaatcaacagacttaataacgttactaatatctttttcataaagatctcctcttttacaataattttatatatacaagtataatagaacttccatggcatagccttatacttaaatattataatattttcttaatctttccaactcctctttgctatatctatgagaaaaatctatttttttatttttgaatatatttactaaccataaaccaacatctattggatctggattttttattaaatttgttgaatatggtatattataatattcttctttattcaatgtattaatattgaactctcctccattatcattaatgcaatagtatatcctgtctatctcggctataatatattcctttctgtcatttataacatctacagaacaatgttttttcactactgctagcatttcttcacaatagttttcattatatattccccatactttcccgtttcttaatttcataatttttcttcactccctatttatttttagcctttaaaagccataatttttattctaattaattattattgcgaaataaaaaaaatcagatataaaaatacctgatttaatattctaagtccattctgtccaataagtatcggtttctccattactatataatttattaaattcttctaatgtcatttctgactttaaacaatcatcattacagaagtacttcattccaccatctatgcaatatccttctatcataactcttccgcaattagaacatattcttgtttctatttcctgctgctctaataatgcctttaacttttctttattttctttatccaaaactatattggccaatcttataaattcttttattgtatttgtactcatactttttcctcctaatcttagcttttatacgccataacttattatttaattaattattattacttttaaaaaatttattataatttgtccttgtaatatcttaaggtatatattagtataatatataaggagttgtaaatttttaaatttataacttttccttaaattttagcttaaagccataagaaagagtatttatatattatcaatactctttcttttttttatattatacatattgctattattaattaatatcatcaaaagatgctccctgaaaaaaactagaataaatttcttcttttaatgtccatattcggcattccgcgtaaagtttatctattactaataatagatattttgtattttttcttaacttatttggtatattattttcatccaaataatacaagacctcatcttctattaaagattcctttaatagatttttattaatttcttcagtcctttttctattcataatatatgtcaaaattctacacttcatatatattcctcctttaattttagctcttaaaaccatgatttattatttaattaattattattacacttgtttaaaatttttatattttgtatatataataaatatcacatccccctattaaataaaaaataaggcactatatataattatttacatatagtaccttatttttatttgctctttctaacatctattttaatttttgtcataatgttttgtacatcttctttatttaaattttttcttttaatcgcttcttgaaaaatatcacttataacatcccaatcacatattatatcttgttccaataagttttgtatttgttttgttctctctttatcttcactccaaaatttaaagtcagatagaaaatcatgaacatattctcttaattctataatagctgcagcaacagcatcttcttcagtgggtttattaacaataatatcaaagtctttaagaaacacagttacactcttatcattttctatatatttatcatatcttatttttttataaatcaaattagcacctctattttctctattttataatcctcaaatgcttcactctattactttttgcttttaatactgtatctgtattattaagtgaatgctcattttcatttaaatctgtattaagagtataagtttctattccatttttacggaagaattcttgcattaatgatggttcaccattcaacttacgcaaattatttagactttccgtactattcataacaaactcaaatatatcatcattagtatatgcccatagaaaatctaaaatattttcattaccaataggattattttgattcaatttatttatataatctcttgtatagaaataatcttttgcacaaaatttatgtccattaaaatctttttttataggaaacaaattaacaaattccctcggtgttaatagggccatcatatcatttaatacaaatattaaattaaaattatctatttctttttctttcctcactgcagttagctcttcggtattaacacttttaactccataaaaaattactttttttaatagataagtcttatcttcataatgtttaggatcttttcttaaagtatcagcatattcttttaaagcattgtaaaaggcattataatatattagatttaattcattattaggcttttttatcattttagattcgctcccttcatacgtactaatagttctataattcttctaaaaaagatatactaatatattaatttaaaaagattcttttacaacaaaaataacaaatatataattaattttagatatctactttattatctaaaattacttcattgtttaaaaattttatttcttgtatatataataaatgtagtaattaaaattaaatatttattcccctatatttaatttatccatccatacaaaaggggcttgcgactaaaatatatatagtcacaagtcccttattttaatataatttctatatatgatatatgaaactatagttaaacctataatttatactttttaccatggcaatcataaaaattctttttgcttccacaaaaacaagtatttaatctcttattggattttcttcgcaatttatataattcaattttttcaagtatatttttcacatgttcattttcatttatttttccttcactgattgctatttttatattttcctttataccgggataccatatgtctggttttactagataaattcctatcatataagattcaaatgctttgtcataatttccttttattaaatatacaagccccatagtaaaatgtgcaaccgaatcatatttaacatttatagattcttcacacatttccaatgcttttttgtaatcacccttaatgtaatatgcaaatgctaagttctctaaattttcatcctctcttaattccattaaaggtatagattctataaacttttcttcagtcaataatttttttagcgcaatacgattttctatctcattatcaactatcttaaaagtaaaagttatgtcttgtttttcacaccaaaatccattcttctttttatttatttctatttcaaattttcctgttggatatgaacctgtgcaattcaatatctcattaagtgctttatcaattggatgattttcatttctaaatatattaattattttagcacaataatcatacatcttatcattaaataagaacctttgtatatatatcccatgttccctctcatatacattttttataatatctttactttctttattattaggcctcattttaataaagtctaaatttataaagtaagggaaaatacctaagcatgtactaagtaaaacattctcttcttcatcttttaatagtaaagttaattttgtttgctcttttggtgtactctctcgaaattttttcaaaaatctctcacaaatatctttatcatttgtatcttttcctaatttttttatcttatcttgcatatctttcgaaataagacatggaatttcatcagttctaactaatgctgtatttaaaatatctttgaaattttcttcatatttaatatcctcaaaatttattctatctggaactattgtaacaacattagaagtcatcaatccatgaattcgcaatcttcttaatccccgattactccatatattcatcatattattaaaagaaatattatctgatattctttctgaaaaattactatctatgttaagagttattttacctttactggacatctccatatgtaaattaaatggatatttatctacatcttcagacttatttgtaaataaatatatatctaattctcttctcttagcatttatttcaaagttaaataacatgtatatatctttttcatcataatttatatttggtattatccttaatgaattaatcacacctgattcgtttccaaagctattattaaattctatatcaggatcaggtaatttaatatcctttaattttatatttctactaagctctacagggacgccagccatgcttgcagcagccattatagttccgaaatctgtcatatctaattgtttttctttttttactgtagttattttaaaagttcctatagagttatctacattatcactttcttccttataaaactcttttaattgttttttttttttacttttgacatactttccataagtttaaaaaagtttaaagagttttcactcaatgaacgctcaatagattggactgcataaaaagtatcttctgttaattcatttggatatttaagaacatcaatggaaaaggcatgtagcaacccataatctaacgttactctacgatcagcatttccaaattcatatggagtatttctttcatccataaaatactttagactagttgggaaatgtgttagaacttcaattctatcatctttatcaccctcatcatataatacaccaaaattctcattcacatatatcataaagtgctcatttaaacatgcgtttacatacacagattttgtgaattctaactctaaatgacttcctataaataaatttataagttctttaaatgaatttatattcctatttataatatatacacctttttctctctcatagattatatattttcgagattgtaatgcactaatagcatcatcaacatatctttcttctcttttatttgaaaaatgctcataaatcattgcttctgtaacactatcactttgtgccatgaaaattagcaattcttcttttataacctgagatacatcaatatttatctttatatcatctatattaatatcattatcctttaagatttgcttcacttgcaaatgtttttttaatatttcctcatacatctcatttattgcattttctaattcgtgattatatgcaactgcctttatattgatagaattattatatctattgataccagtcatcacttcatgtctttcgtgatgaattaaactttcattacttattcctaaaaactcttttactaaatatggtgctctttcttctaaaaaatctaattcatcagctaacctaatcaatgcagataacaatttaattcttatatttcctccttgtccatatgcctcacattcgtcaagtgaatccaaagggactactctatgactacaagctattctttttattgcattagcctctttcatatctaaacctaaatctcgcttaaattcatcaatgaaatctcctgatctctggttatgagaacttcgaattttttctccatatccagcatcatctataaacctactattaccaaccattcctatatcatgaactaatgtagctacaataagtaaaaacttttcatcatcatttagaatactaagagtttcattaaaacagataccatacaaattttctacacttaaagaatgctcaagtgtatgctcagtaaatgtaggatttacatttgttgttcttgctaacaacggtcttaccatattttgtatagtttcaattcttagcttatattcttctgataatgaattcctaagtaaatatttttttctattttccattaatagctctccttttatttcaaaatactattgaagttctttataacatatttttattttataaccatattttatcatatagtttatataaataaaaaaatatgcttaatattttaatgaaatacattttgttcctaaaaaattatatgacctctacataaaaatccatatttctaagattgctttcttgtttaaaaattttatttcctgtatatataataaatgtagtagttaaaattaaatatttattccccctatatttaattttaatattttacattctccatccacatataaagggacttgcaactaaaatacatatagctgcaggtccctaatcattattctattattgtttttatactttttaatacttcacttatttgcatattagcatctattacataatcacaaggtattatttgaaacttttctttatcatgtattattctttcttgtgcttctctttgtgccattaaataattagaatcactatgaccatttacatcaatatatctttttatcattctacctcttctaattttctcatctgcttttaaatataatactaatatttctacatcatctatttctgatcttaattcattgactcccttaacttctactatatatatggatgttcccttatttctatattgttctttagtagcatagtaatgctcatctttatagcaagcataagctattacattttctttaagataataaccatcatctaatatatcaatatcattcctatcatttatactattcaaaaatatgtgtcctctctcacccttatatcgtggcttcctagttgtatagctttttatataattatatccttccttctccaataattctgctatagtagatttaccggacccagattcccctactaaacaaataattatatctgtattgttatcttgcattatataattcctccttaagcttatacgtttgaataaattaactttctcgaatttttatctaatctttttttaaatctatttatatttctttcattaccttgcaattctatagttaatttataattaaaccaactatatttttttataattatatttttaatacttacattataacttccattggctataattaaactacttctaaattgctctaattcttcttttttaccaataatgttcaaaatcaaatatcttccctcctatatttttcatcatttttagttcttaccatatacttttttaaaattattatttcaaaaataaaagaattacactaattatttgtattgtagataataacttcttgatgcaagcaacatttccgacatttatttataaaaaaataaagtgatgcagttaactacaccactttatttttattattattttaaatatataaaatcagatttttttaaatttcctcaaaaacttttaatgcctcttcttctgtcatttccattcctctaggacttccgcatgactgtgggtgtccatcaaattttatgcctgctacttcttttccagcaaaaacatattgagattttggattacagtatattgatattgtcttataatgctgcctatatacaactacaatatcataactatcttcatatgcccttgaaggatttaaatcatcctgggcattaatagaaaacaagattttattcttttgttttctttttaaagaatttatataagccttctctgaactttcttgtactttttctcctatttttattattttttctgttgaatactttaatatttcttctataatactagtaacatccactctctcctctgatactctaggaatttttaaattcctttgtaacctacctatacctagttgatataataatgctttgttatatttatctctacatatactagaaccattattatctatttgttctaacatttctaaatctatattaggcaagtctttacctaataatcttaatattcctacatatgtatctgcatccatatgtgtaatttctatagttgaattttcttctgctataggtatttgattattattacaagggcttggataatgttcaaattgaccatgatgatcaaaatgcttcagattatctaccttacctgcttctattgaatatccttgaaattgtggtttacttgttaatattattctcatttttatattcctcctaattttagcttatgaaaagcctttgtttttaatttatttagcataatgccatataaactttatatatttattattacagaaaatagtaatcgtactaatttctcatttttataattaagaaattataaaaaaccagaatatttatccttataacattactgttttactataactaataatattaagaatataacttctaatattattgaactaatcataatttcatttattaatttttcttctaattttttattgcttaatttacttttgttgcccatattattttaatcactcctataattttagcttttaataagccgttaatatattatttgattaattattattacttttacaataaaaatttcttgtttaaaaattttatttcttgtatatataataaatatacattcctccattttttaattataaagaaggtgttatatcatttcgcagatatagcaccttctttataaattctattttattttttaaattaagcagctaatgatacagtatcatcattacttttaataaattcattcggataagaatttattatctgcctaattttagcttttatattgttattatttttagcttttttgcttttaataaccatattatatatttcttctcttgttgttttccctcccaaatattctataatattttgtattagagatctccaggttatttgttctacgtctaacatagaaaagattcttttctttactatagtacaaggtattattaactcttgatctttttttattataacaagatattcatgctgtataggtatgaatttattagcatatttaatattgtctgaaacacaattatactgtttttttataataacattttctattttcccataaacattcatttctttaaacatactataataatcacttttaaagcggctatctcctactagtaatgctattctcccacctttctttaatgctaaatagcttttatataatactgtattgaaccatttagtaaattgatttttatcatgcatatgtgatccgtcatcaatatgggctacatttccccattgatttccactatatactggcattttagagcccttaaaaacatagtatggtggatgtaaaaacataaactcaaatgatttaggaaattcatcctttattatattgaacccaccaaactttggatttaggtccattcctaagcactttatattcaaatcctttgctacatctaaagatgttccactacctagcataggatcacaaaattcttttatattataatgtaaaagaatatcttttattagaagtccactgcagttacctctccagctattactaccatatttacctctggcaaaatactcagctatacttgttaaccctccaacctttttgaaagatattctttcttgtgttaaatctcctataaatttatctcccattttattttctaatataacttctttttttcttccataatctttaatatcaatatttattatatcctttgttaaatatggatataatttttctaatacctttccttctaacataattaatcctccttaaattttagccataatttagccataaattattgattttaattaattattatttcattaattctaaattatatatattaaaaaagcataaagataataaaatccttatgctttaatcttttcatttttatttataatggtgtaaaattccttttttattaattcattcggaattttatttgggccttcatattcatgatactcctttagtatattcgatattaaggattcatatatataatctaaagtttcttttttgaatcttctggccttatctgtttgattattaataattaaatcatcaatacctttgccatatttttcattccattgtaagtaaattattttatactcaggaaactttttttctatggcatttgacatcttttttccttgtgtatatacttgcaaattaccaatcatatcagcatcaaagcaaatatatattggtatttttttgttttttattcctttatactggcaatataaatgaaatttatttattgcttctttatattgctgtaatctttttatttcttctattacttctattatttttctccatgttgttactccttgtacactaattgctattactcctctttctgctaatttttcagctttaaatctcccttctgttattgataaggtgggattattaattatttgactaggatatactacatctattggacttcctgctcctgttccaaatttgtatttatcctcgttttcctctaaatttgcaaaggaagaagaaaaccaaatgtatctttgatcctgtttgttcctttttttatcttttctaatttgaatacctactatttctcctttagtatttcttatttttatacctattcctttatattgtgcaaaagtatattgattcctttttatatcaaaataaaatcctggtatactttctaatattttttcattatatccacatttatttaacttatcaacgaattgattccatatctttcttgtagggaatgtaaaataatctctattaatacgatgtggagcaatttgtctttttgttaataaatgaatataatgtgcactatatatatcacagcagcttgtaaatatttcatatactttatttaaagtatatgaatttgctttaatgctcttctcattattagtttttaccatatattttttttgcatatttttaatttcttttgctttatactttcttttagaaaaatattgttcatattctacactgctaataagattaaattctagtcctatattaaatgcagcttctacataatttactttatcatatagtgctataaattgaattgcatctccacctacagtgcaagtaaaacatttccatattcctttagatggagttactataaaactaccaattttatgatcattatgaaaaggacatattcccatataatgcataccttttcttattaattgtattctagttcctataataatttctagagatatagactttattttttctattaattcttcaagaaattgttttttattcatattgatttccccctaatatttatctatttaaatatttcttattccatttaatttttttagctataattagccatataattcattcaattagttattatttcaaaaaaataaaaagtgataattagatatttgatacctaactatcacttttatgttctctattatttaattttattacttacaaattatatataatttcttattatttcagtgattttatctaaatcttcccttttaatagcattccatgtgaatttcttaagtttatcagctagattatcataatatttatcttttttatatttttctatatctaagattataaaagaagattcacccgctccattcacttctcttaaagtattcttaaaaaatctctttttttttgcatgcctcaactgtaatatatcttctacccactgcttctattattgtttcttcaattttcgatgttctcccttgatatatacatacccaaactttttgaccttttcttatctccatagtctaataacctttctttataataacttcaactcctgcagctgctatttgaaatacaaagcaaacaaaatcgattagcttctttttataatttctatcaagtctgtttcaaatagtatagaggaatttccatccgtatttccatcttcatcttctaaatagaagcctacatattgataatttccactatcaaaagtacctattccataatgcactttatatatgtatgtttctgcgttatctaatatattataaatatcaggtgtatactttatttcatcaccttctttgatttctacaccctttctgtcagataagcctgtctttctagttgtacaaacatttatttcttttccgttttgtatcattctatacaccttccttataccatatttaattgctcacaatatttgtgattatcctcctatctttcataatgatttcagaatatatttgtattgtgcactaagttaactcattgcctgttaactgataataacaaggtttttttatttctaatttttcagctttatttatatcagttgttattataaagttttctattaatttatttttaggtaaattaaatatgttttctgcagctttaggattaactataatagtaaaatcataatctactaaaacctcaagcatcataattgctgtttctaatttgcattttttcattttatcttttaccattttatttttaggaaactctataactttcattgtttttaaatgcatatctctcaaaatatccctccatatttaaactaaaaattaaagtaacccatttctctttgcttttataagtttaaatgcattttctatagattttgaatctttctccgttacaactattttttctttatcaacatgattattaagccatactgtttcattaatccaatcaatttcaataatatatggaatttctccatagtctttagtctccatagttctacctctacctaattaaattcatatcataaattgtataatcgcatctatatattaataaatacttaccatcaattaatattcccgtactttttggaatgtctgtagcaaaataacttacattatctccaacaaatgttgctaacggttttccatcttgggatcttattaaaatcaccctttttttccctgatgtaatattcttataactgtctacaatatttcttaaaaatggacgtgacttgtctttattaataatttctgtagtttttaatgtatctttcattaaatcttgtaatccatcttcttggagaattaaactacttccaacgtgaattatttgattattaccaactgttatatttaatacacttgatttttttattgtttctcccttttcatcctgctctttaaatttatcatctaaagatatacttatacttttaccctctatcctatctaatggtttactttctttgtcgtatgttgttattattgcattcctacctttaaaatgctcttgcaattgtttatactcatttcccaataaattacaaccagaaacaataaataacgaacttactaaaactattgaaactataatgctttttatttttgttttattcattttaaacatccccttcacaattatttcattcatagatctaatctttgaattgtggaattaaattattttcaactgtttacctttttcaagatgtaattttattctttccttagcttcattgcagtgcttcttttctttttctatacaaatataatttctatttgtatttatacaagcttcagcaagcacacaacttcctgcagtaaaatctagtacggtacctccctcatttgtataagttttaattaaatattcatatagctctactggcttttgatcttttatcttgattgtgttatatggaatatctattatagttgttggatatcggtctgtttgacctccaccttccatacctattttagtcttaccatagttggcacctgcggtagtgtgctgcttatatttctttactggcttatgtccgtaagtcttctatggattatagactggtaaccttttataaaatatagggatatctatgtgttgtcttaaaggcatcctattagcatttaagaaatttgatttttctttaggcttccatatccatgaatacctgtagtactttttatttgaaactactaactctgatgtaaatactccagctgccattaatgctatagatgcattatcttttgcaattctatttatctcctgccacattggctcaaaaggaattgctttgtcccattcattattagtcattccaaatggtaaatctgataaaaccatatctattgatttatcatctatttttttcataatttcaaggcaatttcctaaataaatattatttacttctagcaatatatcaccttcttttctgtcaccttaatttcattttttcatgaatactagccaatgtgtctttgctcttttatttcccaataaaggtttataatctataacttttaatatatcttttatttttatttgttcttcattccatttaaaaatcaatattccgtgtttatccaagaccctcatgcactcattaaatccttgtcttatatctattggccaatcactatttaactttccatatttcttggccaaccatgaattttctccagcctttattaaatgtggtggatcaaaaactactaatttaaaggtattatctttatatggtatatttctaaaatctcctagtatatctggctcaataataagctttcttccatcacataatgtatcttctaactctctgttatccataaaaataacatccttattttctttatcaaaccaaaacattttacttccacaacatacatcaagtattggtttttgcaaatttatcacttcctaactattgcacaataatttcataggttataagatacacctacgcttgaattgtggcattacatcattgcttctaaatgtaattccctatacatttccgattcaaatacccaatctccaatatctttatcttcaaagtcacaatcatgcgtattgtaataatattttccatttttcaattcaatgctacacacttcactttcaaagaatctataatcttcgtctatcatataggcaatatcacctaattgaaataattgttttgtatttttgtttactttttctattaaattctttagctcattaaactctaagtcaggtcttttggtattacatagagcaattattttatttttttccttgtctaaaataaaagcatctgtaggattttcaattacaagttcatactttttcatccccaattcactcccttacaataatttcattcttagacctatttttcaattgtgacttagctaaatcctaaatccaaaattgtccattgttgcctgtatatcaccattaaattgaaaataagtatacaagctgctttccttggttggtactgctccaaaaaactttaattgatttattaaattaccttcttttttattactgaattgaacttctgttttattttcacctattaattttactttcattttatcccctccaaacttaccattttatatcttctttaaacattttataagttaataatacaaaattatctttcaagatgtttacagaaattatttcaagattttgattcctttttatgaaatcttgataatcatacactgcttctaacactgttacccctgtaaacaattttgtttttatcattaataatcactccatttgtttactttgtatttatttcatagttttaataactctttgaataccttttttaaaaatttaagttgttctttattgaagtggtcttccttgaaactatttcttgagccagcacttataataattccaatagcaaaagaaagttcctcagtattaagagtattaaaatctaataagcaaggctctgcatatatagcgttccatatctcatcttttcttttaattgatatcatttaattttctcctctctaacttttattagatttattttgcaaattaatctaagtttttacttatgccctgtttttgtcttagaattcttgtttttaattaatatactggtattataatttttattataaaaaacactagtaaatttaatattaaatttactagtgttgtatttttttacgataaaaattataatatagctaagagaataaaattatgatatattttgtaccatccccaaatactattattctctctccaaaagaagttgttggttatttttgggggtggtaactagtggatagggtagacataataatactgtcacttatatcattgatagtattaattatagtattatcaatggttttacctaaacaaaggaaattacaattatttacattaaatataaatatcttttttataaaaataaatttaaaaatttattacaaaaaataaaaaagtgtaaatacataccttcacaaatgtatttacacttaaactgagaaatatatcatattgttaataactaacaacttctttacctacattataccttatacatttattaaagtaaatatgatattaaactataacatagcaccctcctaaattctattgtattacaattattgtatacaactaatgaaaattttcatttactcttttatagccataaagtatatcttataatttattataatctttttctatatcatattaaatttgtgtatttttaaatatcttattagtactgttatagtgagtttctatatctcttgttatcattacttttgcatacctaccaattacttgatcttcgatttctgaaatatcgttttagtttttcttaacaacctgcagttcaaatgatccttctctatctcctggtaaaattaaataagattctcctaaatctgacaatactttttagaactataatcacgcctactatttgaagtgttttgtttttataatcatatttagaatatcatgaatgattgtcaagcttcgcttctaacatttctttaaatgtattcgtaaataaatcctctaatgtttattaagcatcttttgcacttgtagttttaattgtttaataaattcttttcttgaaaaagacataatctgtgaaaaccccataaaaataatataataatcgaaactttaatttatacaatataaaatcataaatattttatcatttattaatgtctattttatctaagctctcaaatcttactaaattatatttcctattgcgaacccttaaacctctctattaaaaattatagtattctttttaaaaacatcgtattgctatttaatataaaatatttgggatagtaataattctgcaatcattatcctaattactatcatctattttcttagcatacttatctcttattttttgtactaaagtatttcccatcattcctgattcactatattattgtatctctattatttattagcattttcaatagcaattattgacttcatatttttaataccaatatataataattttttgtacataagatatattcaaacaacttataatgaataagctaaaagatgtagtttatttaatattaaaatttagctacatcctttaaatttaagattttataaacttaaacttttcttatataaaataggtttgctgagcatatagttatattattcagtccacccttcatctttaggaataaactgccaattacatcccaattttgaattatatggtttcctttttacctcttttaagtaccatttacttatacaaaaataatctttatactctttaaatacaattccagattcgtagaaacgatgaataccaatcaatcctatctcatcagtactttcttcatcttttttaaaaagcaactgacaactatatgttggctgttcatcatattcttttatttgtatagtattgtaaaactcatcagaatcacttataggagctaaaaacaatttttcttcctctttcttaaaatatttatacatatatactctccactcttgatttaaattaaaaaaatctagatatatataatcttcttttctaactatatcatcatttatagattgagaatttgactttcttcttataataaatttttctccaatatataaatctctataatttatatatttggaattttgattatatttgctacgtgttaaaatttcacctacagatgaatctttctttagtttaatatatgaatttttattccccgcattaaacatataatattctttattgtacattaaaggatttccccaaaaatcttttaaatattcgctatatgattgaattttatatatttcttcaatatttgattgacttaattccgtattaaaaatactgaaatatttcatccaaatgaactgtgttctatctatattaccatctaatttaaatattatttcatcattagcaataacttctcttatatctctaatatctatatgtgattctagcttaccattaatataaattttagcgttatccgaattattagtaatagttacaaaaaaccatctatttatatactctgatatatcttcttttatgctatattcaaaaaatactgatttgatttttccatttatatcaattaaagtccatattatcatattacccctaatagatattttccatccagaattatttttcatacaattaattattgtatattcattatgaatataattttgtataccatcattcttatatttaggtattcttatccaaaaactaacgctaaaatcaaggaacatactattaaatatgatattctgattttgaatcactctaatcttactatttgctgaactagttaatttaaattgatttttatcattaagcttgaccccatcatatacctctacctttgccccatatcctgataaatctattaacttattatccctatatcttaaatttaagataatattatttaaaatatcgctattatatttattaaatatttctattagtattgtattattagtatacgttgaaagatcaaatggtatactggttttcaagtatttatctacttttgatttttcatattctgcacttccaatcaaatataatttattttcatctatataatttaataaattttttctgagagtattatcgaagtctagtaatttttctacagctaatggaatcatttttttcattaaatatgatacagaacattcatttataaaattatttatattatctatagcttggttaataccctcattaagtttagaatttacatcattaaaatcgatgttaatatttgacctttctttctcagaatatatattatatttgtattttattatttcttccaatgcttgtgcttgataatttaaagccttatacattccctcttttattgtataaaattgagtattaactgttgagagccattgcgctactattaatccgtacatatcaatccatttttcatctcttttagttaaagcactatttattgtttcaataattttatttttattgtcaatatatgattctaataaaaaagctccaactacaggtattaaaagttctggtataaattctagtagaatactggctcctgcaatctcaaaagcattttcaaaatttcctttagctgtttcatttcctacatttaaagctaatcctatataaggaacaattagagatatatctgcaattttatccatagtactgcttttattagcttcgattacaaaatcatctactatctgtttcacccaacctgcaaataatcctgcttctaccactttattagcagttttaatataatccatagaaaaaaatgaataaactttgttagaaaataataatgcatcatcaaatgaagatgttaaacttatatctcttatatctagaggaaatgtctgagagtataaatattgaaagatggtattttcatctgtaaaaattttttttatagcgggttgttttttatatactggaacatatacattaaaatcagtaagtgattctgtattttcacttggtaattctattttacttattaaatcagtatctaaaattaattcatttatagagaaatcattttctatataattattctgtgtattatatgctattctttcgtttttagataaatcatctgaaaaactatttttatcagctataaagaacaaatcctcattatcaacatcaatacatattcctggagctttaacacttttacacatttgtatcttatatacagccaaatgctccttgctgatttcttcataagcttgtttatttatagctttattctgacctctatattctttttccatatttttatcagatatattaaacccttcctctatagtatagatttcattatctaataaattttttatttttactggtggtaaggaatcactaaaataagaagctctagtttttattttataattttctgctatattagtttctgtaaaaccaaacattaagcttttatataatttatcgaaactttctacatctatactatattttccctcagaatcttcaacgaatttatatttatctttaaatttatttttatatatattaatattaatgttaggatctgatatgcaaactaaaaccttgttaagtctatcaactatccctctaaaattttgcaaaactttatcatagatacttttatccgtagaaggacttatgatgctgggatcttgtcccccaaaagtatatagttcttctgcctgtatagcatctgtagattgcataaaaaattttttttcatttggtacgattggtaaatcatttactttaatgccatataatccatgtaaaacatgtataagttcatgcattaatattaaggctggatctgaaaaatatccacgtctattaaatatacttgcgcctttgttttcttgaacattattaaatacgcttacatattctgggcaaaacttcatttgcattatacccccgaagccttcccttgatgcaaaatgattttgtatacctatatctatagtctcattttcatttaaaactggcccaggtccaaatattatcaaatttgcgaaaatacctttttttcgctccacttctcctggattactgattaatttattaacagttacactagcaatgtttgtgttaaactcttcgagtggaacacgtctatctccaagataaggtataccatttataatcatctctaataacttttcacccaatggttttgatttgattctattaaataacttgatcattgtttgtaaaaatatattctttttatcattagtatttaagtaatctggatcataatattcacaaacatctctattaaaaataccggaacttttattaaaatcctcaggtttatatccaaaagtatatctttccggtattatccaaatacgatctgtgattttaaaagctttataatatctccccatacctctcgcaaatggaggttccatcataataatattattattatcaataggatcattataattaaaattatttattgtaactggcataaatattctcctccttattttaagtttatatcccttttaatgcccataaatgtgcagccttaggtatattgtcattattattacatatcatccaattataatttctatctcttaaggataaagataaatatttattattataagcaaatgtaaggcaattaggcctaaatatatcgttattaaatattattctctttgcagtatctttagagctaactaattggattctattattttcagaggatatatctacatatttttcttcatctcctaataaacaaactactccttcatcccacttttgaacatattgcttgtttgcgtcaatatttattaatttaaacttagcaccttgaatattaaggttatttgtatctttaattgacaaatatatattattgttttcagtaacttcatataacgagttttctgggaatacataattgtatagttcataggttttattatattctaatctttctccagaaatatcccttatatatgaattatttaaataagaaaaataattatttacaacttcttcactggtaatagatctatttaaaatagataatccttcaatatatattggattattttcattaactaaagaaattgtattacttgaataaatatttaaaatttgttcaatactttggttagcaataagtttatcattaataaatattaataattgatttcttaatctatctatggaaattgatatataataccaatttttacttataacatcggataaataaatattctcttcattaccattgcaatctacaatgctgaaaactaatccattattttcaaaataaatctcccatccacaattatcagctttattttctattagtttagacgtaataatatcttctcctaaatttcttaaccaaaaacaaattgaaaaactattagttaacccattttcaaaagccttattagaaaaactaacactttcatcaggttcttttaaatataatgcatctccatttactccataaactaaactaatagaatctgaatatttaactaatgtattcttaccagatatgtcttcaattactttgttattatcttcctgtaatgtaaataaaaacagattataatccgactctttttcttctttaattaaatcagtttcagaagtaattaaatctttaatactttgaatatcaaaaaactcaaaatctatattcataaatgtatttaatttaattaattgtaatttttcatcttcagtgatattagtgcacttttgtataaaagctgttacattactatttacactattaatacattgttccataaaagaaataaacttaggatatatatttgtatcaaaaacacatatagctgatttatttaaaaagtcatttatattatttattgctatttgtgattcatttgataaatctataaaagttttctctgtagctaagttcattaaatttaatttatccattgatatatcagctttaaataaatcttgaagcttattttgtattatttgtttaattagcttttcttgagctagtattgactgttttgccatacaaattaaatcgaaatactgactataatattctgtccaccattgatctaagaaattaaaataaacttttttgaaataaagtatattttttaaatatatgttaaataatttttcatttaaatcatttagtggtaatcctaacatatcgttagggattccataaatctcaattattggcatacttaaattttcttttttattaataagtgaaattggtcctaaattttgaaattcttctacaaaagaatcggatgtatttaaaatatttaatgcttttccaaaccaagttactactttattaataccgcaatcagtattaatttcttgagttgcagtaatatcaaaagaataatttctaaaaatctctcttaaccataaataatattttttatctgtatcaataggactattatcctttatggaatctaaataaaacattacattagataagaaagaatacactaaagatttatctttagaagaaactacttctacaaaatctgaggataaactaaatttttcattgttagtattttgagcttgtaaataatttataggccatggtatatttgtattaatttctctagtacttgtaattttctgtaccggtgaaaacttatcacaattttccttataaggatttacatctataatctctggaatattgtctattactccaatgttaacattatctaaagaagaatcatttgaattattaaaatgatattcataggctctattatatgggattttataattactgtaaaaatcatctacagtgctttttaatccatcaccataaatattacttctcattaatgaaacattatttccatttaataaattaattatttcttcaggtttatttataatatcttgatttctatctgataaagataattgaacattaatttgaccattaacaaaaccatttatactataattttctggataatctattttgtagtattgttttctataaaaatgtttaagtgcattattaaatctatctggcatcataatgctaaactctttagagaaataatttaaatttaattcccatatatcattgatattgattcgaaacttttgttttaatctcaattttatatcattaccaatggcattatttccttcaatttgtgtttcataaatattcctatgatcttcaaacactttttttgcatttgagaaataattatctgtaaaccaatatggatctgtatttataaatttaggatcaatgcctccagatactagtaaatcaactatattcaattgtgagtattctatattctctaattcacttcttaatctatatggaataactaaatcatcactcggttttataccatataagaaataaagagattttattaaacattttattaattctattgcaggatcaatataaaattcgtcatatttataggttagaaatggttggaaccatatttcagtcattgttcccattccattttctgcatcttcctttttataaaaaacagtattgttttctactatgtttgctcctggaccaaaaataactatattagatgcatagaaacttttattatcttcagatgaaagataatttgtttctctatatcctgcataaggaaatggaatagtacttgaaattaaagaattcaattttttattagattttggtgctgatccaaaagtaatcatattaggtgcataataccctccacctatatatccataaggaaatggaatagctgtagaaatcaaagataataacttttccccagcgttagtactattaattctttttaacaaagtaataatggcttgtaagaacttatctttttcactatcttgtgaaagaaaattagaatcatatattcccccatcaactttatattcttcatctatactcaaagattcgccataatatctctctggcgccacccaaatattgggagcaaccttaaaagccttaaaaaccgtatcagtttttctagctctaactactacaacatttttattatctaccggggaatttatacttaagttgtcatttatattcatatctaaccaccctcctaaatttatttcaacgcacatacttttaattatttactatacacgcccccttaaattttggatacatttttcagtatattcttatcatttatatataacatagccacactattttttgtaaacctaaaattttttaaaaatataaactacatattaattaattttttcaatatgggttctaatctctctaaagccattattttatttttatatacagattgacgacttatattaagttttttagctatatctatctccttaatatcttcaacaaatttcatatatataattttcttttgatcgtcaggtaatatggatattaaatcattaaactcaaattctgaataacttgaataactatttgctattaagcttaatttcttatctgcaatttctgaattatatattattttcttatcaatctttcttttattgcaaatatctaagcaatatctttttaaagtcctactaatatatctctctaaatcattttgtgtattgaaattgctcaaatcaacttttttaagtgtataccataaatggtacaaaatatcattgtaattatcatatatattatattttctagtaaatatatttatagttttttcaaaatgcttaaaaatttcttgaaactcctcattgtcattttttaacatttcaatttgtaaaaacaacttattcatatttaccactatccctccataatatacatattattgttttattatactataaatgaactaattgcctttaaattttaataagccatttttacgaaatatccataatcaattatgtaaacatactaataaaaatttgatatatttaaattttaggtttacaaaaaataatttgattatgttatatgttatatgtaagattaattcttaaataaaggaggaatcataatggaacactattcagtaatccaaaattcattaaatgacaaaattgttaccatctcctgtaaggccgatactaatttatttttttatcaagttgccggtaacgttagcttatttcaacaaactagaaattaccttgaaagatggagacttatatatgattctaataaagctgcttataaaataaaaagtatggatatccataatactaatttagttttaacatggaatgcaccaacacataatatatcaacgcaacaagattcaaatgcagataatcaatattggttattattaaaagacattggtaacaattcatttattattgcaagttataaaaaccctaacttagtattatatgctgataccgtagctcgtaatttgaagcttagcacacttaataattcaaattatataaaatttatcatagaagattatataatatcagatctcaacaatttcacatgtaaaataagtccaatattagatcgtaataaagttgtacaacaagtggctacgacaaatctaaatgttaatttatatacttgggactatggtcgcaatcaaaaatggacaattagatataatgaagaaaaagcagcataccagttttttaatacaatactttcaaacggagttctaacatggattttttcaaatggtaatactgtaagggtttcttcttctaatgatcaaaataatgacgcccaatattggcttataaatcctgtttcagatactgatgaaacatatacaattactaatctacgcgatacaactaaagctctagatttatataacagccaaacagcaaacggaactgctattcaagtatttaattctaatggaggtgataatcagaaatggaatattcgtaacccataaaattaatatcaacaaagatttaatatgagtactatcatctaatttataaagaggtgaattatatgtcagttgaaagaacttttctacctaatggtaattacaatataaaatctatcttttctggttctttatatttaaatcctgtatcgaaatcattaacattttcaaatgaatcttctgcaaataatcaaaaatggaatgtagaatatatggctgaaaatagatgctttaaaatctctaatgtagcagaaccaaataagtatttaagttacgataactttggatttatttctttagattcattatccaatagatgctactggtttcctattaaaattgctgtaaatacttatattatgttaagtttaaataaagtgaatgaattagattatgcctgggacatttatgatactaatgaaaatattttaagccaaccactactcctattaccgaattttgatatatacaattcaaatcaaatgttcaaacttgaaaaaatataaaggagaaaagtgtatgaattcatctataaaaaaaatttataatgatatacaagaaaaagttataaactatagtgatactattgatttagctgatggtaattatgtagttagaagaggggatggatggatattatctagacaaaatcaaatattaggtggaagtgtaattagtaatggatcaacaggaatagttggggacctacgtgtaaatgataatgcgataccatattattatccaacaccatctttcaatgaagaatatataaaaaataatatacaaactgtatttactaactttactgaagctaatcaaattccaataggatttgaatttagtaaaaccgctccctcaaataaaaacttatatatgtatttacaatatacctacattagatatgaaataataaaagtcttacaacatgaaattatagaaagagcagttttatatgttccatctcttggatatgttaagtctatagaatttaatccaggggaaaaaataaataaagatttttactttctaactaatgataagtgcattttaaatgaacaattcctatataaaaaaattttagaaactactaaaaatataccaactaacaatatttttaattctaaagttagtagcacacaacgagtattgccttatagtaatggactatatgttattaataagggtgatggatatataagaacaaatgataaagatttgataggtacattattaatcgaagcaggttcatcaggaagtattatacaacctcgattaagaaatacaactagaccattattcaccacaagtaatgatacaaaattctcacaacaatatactgaagaaagacttaaagacgctttcaatgtacaattatttaatacatcaacatcgttatttaaatttgtagaagaagctccttcagataaaaatatatgcataaaggcttataatacctatgaaaaatatgaattaatagactatcaaaatggaagtattgttaataaagctgagtattatcttccttccttaggatattgtgaagtaactaatgctccttcacctgaatctgaagtagttaaaatgcaagtggctgaagatggatttatacaaaatggtcccgaggaagaaattgtagtaggtgtcataaacccatctgaaaatatacaagaaataaatactgctatttcagataattacacatataacattccaggtattgtaaataataatccattttatatattatttacagtaaatactacaggaatttataaaattaatactcaaaataatctaccaccattaaaaatatatgaagcgataggttcgggtaatagaaatttgcaagctggcaatttatgtaataataatattaaagcaataaattatattactgggtttgacagtcctaatgctaaaagttatttagttgttttgcttaataaggataaaaattactacattagagtaccacaaacttctcctaatatagaaaatcaaataaagttcaagagagaagaaggggatctccgaaatttaatgaattcttcagttaatataatagataatcttaattcaacaggtgcacattactatacaagacaaagccctgatgtccatgactatatttcatatgaatttacagtgcctggtaactttaataataaagatacatctaacattaggctttatactagtaataatcaaggaataggtactttatttagagttattgaaactattgacggctataagttaattggtatacgacaaaatttacacctcttaaataataccaattcaatacgtttattaaatggtgcaatttatatattaaaagtagaagttacagaattaaataactataatataagattgcatatagatattactaattaatatattacgatttattattaaataagagtccaccagcttatgaagtgcactccaaagtttagataaagatctaaatttttggaggtgcatttttgtggcaaagaaaatatattcaacttttcaaattaaagctatagtatatagcttttctaacaaggaaatcatattttggcttattttaaactcacattttttcaccaacaccatattatggcaatgtaatcaagaggaatataactaaatgtctaaatattaaaacttattagtttatggattttaaatatttgctttaaatttatattattaattagacttttaatgttataaattattaatatttctaataaattcattttttttactgataaattaggaacagctaaaaaagatattaattttttatataaagaggtatagaatagtctaagtatgttataaagaccattccattactattatttgcccctatcttctataactttactatctaagttttatagtaaaatacatgttatctagcaatgattttgcttcacattctatatttttttaatctagttcccatttgtaaagatattccttctttaatattttttataaaaaaataaagtaattcaatttaaattactttacttaaataagccttatgattatctgtttaaaattaaatgtatacatgcaaacctcactagatataattattactaatataacaatagataaatatataaaaaattctatgatatattttttatcacacatactttgtaactcctataattgattttattaattataagattattattacattatttcttctttattttataatagttttttctaaattcttttggatattcttaagttcttccgggaacacaggtctatactttaattttaaatcttctattatttcatcatcaaattcatatttttgttcatacaagcctacaagagcttcaattatctcaattcttttataaatatccattctatgttcttcacttaaattaacatttgcaaaagattcctttaaataattataatattcattcacttttggatgctttattttcataaatcattctaacctttcttaacattttctattataaactaatttagttgcgattatatgtgaaattttaaaatgcataaattcacctgctattgttattttgtttacctttaaaacctcccccgtctttccatttaaatatttaatcaattattatatatactaatttttctaaaattaaacacaaaaaaagcatagaaataaattcatatgccatagcaacttatatatatttattatttaatataataataatcgtactcttttattggatttattctttaaactatactaaaatataataataagaagtagacctaagtaaaaaatttataatggaaataaagtttaataaaaaaatataagtagataaaagaacaaattatgctaataataaaaagatacatatatagctgcaagtttattaaaaactaaaaaccgcgacgttgaaaggaggaaaaagtaaaatctatggatataccagatatacccgaatatttaattgaaactatatttggaaatatagatcaacggctaaaacaaaatttctataatttttatgaaaatttatttaatatgaataataaagaagaaaatttaaaattattaataaaagatattatacaaaaagaatttatggtagctgaactaaccaaaatatcagatatggatttacataaaacaaaacatacttttatagctcctgataaaataaacaaactaaagagatataatttacaacaaataaaacaaactaaaaaaagatggtataattcattatttaaaaagaaaaaaacaaatccatttaacattgaaattgaaactgctaataataatataactttatatggccctgaggtattttttaatttatacaaagttagaagtattgaagaattaaaagatattagggcagctcaatttaaagattggctagataattctatatttattacagatttcttttatttaaaaagtaagacaaataagcagattaacacagcttttaatttagactttatatataatatctgtacaataatctatgataaatggaacaacaatttaaactttatatatatggagtacccaaaattattattggatcatcctttagttgcggatgggagcgggaaaattaaagtacaaaagcaaacaattattcagcaaaatcaatctaataaaaatgttaaatataaatacaatgattatgtctctaaagatggaataactagaatattagttcctgaatctaatattgatactaaacaaagtagacttatagacaataaagatcttaatatattatctaatattcttaaatataaaaaagcagattttctaactaataagactatagtctttaatttaattgatattataaataatatttattgttctaaaactgtacgttcttatgaagacttaagaaatagaattgcaaaaatgacattattgaaatttaatttttttagaacagataatatttctggcatccctgatgctgtttatggaattttttctagttacgagtatttagataaatctcaaaacagagttaaagtttacgttgatagtattttatatgataaaatactaaaaaatcaagtatatacaatatataatgacaagataaatcaattgaatgatgattttgctaaaacattagtaatatatcttcaacaagaaaagctagtattgtatactcaaggtaaaaatacaacttttttaagttatgattattttagtaatttagtcagatttagatataaaaaagaagaaagaaactataaaatcattgctcaagccctagaaaacatgaaatgtaataatataattattagagattttaaaaaacatatgaatggatttataataacatttttagatacaaatcaatttgaaatttccgatttattttccaataaaaatacaagtgatatactgcctatgatataaataattaccaaatactcctctacctatctggtgtgggagtattttttataaagaaatttattacaattccaaaaagtgtttcatttttatcgtgcactttttaaaaaatgttttatttttatcgtgcattttttgaatatatttagtattttttataagacaaccaaaaagtgtttcacttttgtcgtgcactttttaaatatatcattatctattcctatacttgtcctaattcattaatttttaagaaaaatttgctaataaaattcactaattttttataaaaagtgtttcactttcgtcgtgcactttataaaaagtgtttcacttttatcgtgcacttttataatttattattttatacattattataattggaatctatactatatcttataaaaagtgtttcatttttgtcgtgcacttttatgatttattctttagttattttattatatttaatttcaacactagtgattatatagtgttccaaaaaagtgtttcacttttatcgtgcactttttttataatattagattgttgtatttactttatttgttcaaaaagttgtttcacttttgtcgtgcacttttgtcattagacaaaatttattctatttgcaataataaaaaatgatctaatatattacagaaaggagcagtattttacatatggcattagcaatagaaaaacttttttttaatgtaagtaaaaacttaatacactttattacagagccaataccattatatcactataagacaatttcatttaataaatgctgttattgtcctttctataaaaaaatgtatgataaaaacatacataattattgttccaattattgtaataataaatataaaaaagtcataaaaaaatataacatttataataacataaatattgataagactcatattcaattttctttaacacaaattaaacaaatgctaatttattattattatgcaaattctaagggattcgtttctttgatatctaaaaaaagaattgctaaaatgataggttgttgtgaaaaaacagtagatataaataataaattattttcagatttaggcttaattttaattagcggtactataaacaacaaattttctttaattattaaagattactctgaacactatagtaaaaacaatgcagggtatcttaatttggctacgaatgtttttaaggacttactacatatcaacaatgtaaatgctttaagaatagctctccaaggcatattaaaacatgacataaatactcttttagatagggaaacatatttttctattaatagtatgaaaactttcttaccagattacataaattgcagatctgccatagaaaaaataatcagtaaattaaatagcaataaaataactatgctttttaacagctctgaaaagcttatatttgttatctctaaaaatctacatggtaaattactaaaaaaagaaatgtattataaatataagaataactttttaaattatattacagaaaacaatattaaattgaataatttaagtcattctattaataatattgtaaaactttctttcgaatacgggtatgatattgttcagttaatgttaggagaaataaaagatatagcaccaactatatttaatgttggtggatatataagagataaaataaagagatacatttatatgaatgaacctttttttgcaatataaattaaggtctttttgtcatgcttatttttaagttttattattcattgtttacaaataatataaaaatttacattatccgtaatataaatttttataaattgttctcattaactatttatttccattccctgttgataactttagaaaaaaatcattaacatagataattaaataaattacactaataataaaaactattaacataaatacttaattttcaacattaagaataaaaacaattctaacaattcatatatctactgatattactatgttctgaaacaaatatttatgattaatatttgtattttaatatttgttctttaatagctcttttcatctctaaaagggaagctcaaattttctatatttattaaaagccttttatttagcttaatactatataattttatatatttataattgtatttaataaaacacttaaaaaaggctgtaatttagttttcataaactaaattacagtcttttttataaaactaacttaaaattactatcaataacactaatagtatatttattatcagttcttttttcagctattatatactcattttgaatagccttttttattatatttataattttttctttaaaagttgggctaaacatttttaagcataaatcaaagtccatttcagctgatgttattattgcataaccagcttttttatattttagaaaatcttttttattgattttaatataatgcatatgatctttttcttcagttgtaaccaataatacgtttgtttcattattgacgtaatataatatttccattcttaaactgcctccattttcatattctttttgtctaaacctttctctattttacgcaagcttacaatgccaatccctttaaactgatatagttgtttttttgaatacattgatagatcttccaatgtatttatacccatatttctaagtgaattataggctcttattgataggtttagttctcgtaattcatctcttttgttttttctcattttcttatttccccctaaaatcatattattttgtactttatcttagtagctaggcctcctcttagatgtctttcagatttattataatctaatactttttgcacctctttagctacttcaggattgattttaggtagtctttcggttatatctctgtgtattgtactttttgcaaccccaaatactttagctgtttttctaacagttgatttagtatttatcacataattagatacatccaatgctctttcctttatataatctttcatttataagattcccctttcttttagcttttgccaacttctttatttcctaataagttattattacaaaaataaaaactaggtatatattttatatacctagtttcacaaatttatttttttgtaaataagttgttatcatctattctttccgctattactttaactacttcattgaattcgtttaaagtcataatattttttaatacagacttccaacctttccttaaattccatattgaaatacagctatttattccaccgccatttaaatcttcattccgcttaattcctttagagcattcacatttttctataaatccagtttgtttcaagtaatatagatcacttatactggacaaacttgttttatattctaataattcaatatattcttctgttactaatattttttgattactatttaatttgttaataaaaattttttccattcctacaatcctttccatctaatctgatataatttttaattttagtttttaaaccatgtaaatatataaattattattacaaaaactacataataagtaaataaaagtatcttttaaaaaatacttcaatatctattgcgcaattttttattgttctatattaatattacgttaatactgaaaggttactatatttaatttttttaatatagtacttttttattcattacactttattttctatttctatataaagtgagttaatttaacttattaatgctatattatttatactaataatgattaataatgcttttatacgtgaactaatataaagacatttaactattaaagtttactttatataaactatgatatataattttaataagaaatattgcaaggaaggatttaataaatgtatgagaatttagatatttttcaatttggagagtatattattaatatttttagtgaaaaaaagtatagagagattgatgtgttctttaatgatatgcatataaaaattgataaagaatctactgctaataatatagtacaaaattatacaaatgaaatagttgacagttttcagagtacaagtaattgtaataaaatttattctatatttaaaagaaaagactattaatgataatttctatacattaatagtcttttcttttaaatattttataaactaccccatttgtctttattgttttctactaaattaataagtgcatcatcttctttgcttgattgattatttttattagtagtaggttttttaggagttattttttgttccatattttctgacaatctattttttatttcattaaattcttctggatatttttcattaaaatactctatcagaatatcttttattttatttgatctatttcttttagtggtaatatcatttagaatttctaatatagtcatatctaatacttcatcttcatagaaggcaataacacttctatttagcggctttgatgtcattttctttcaccacttctaacttatcagcatattttatattgctatattctttcaagccttcagctattgtatattgacttctattattttgtactaataatggaattttatatgcttgtttaaatttatctgatagaatagttttaaatgtattattatttaataatccacctgaaaaaatgaaggtatctactgtaggcatatatttatacatgttattttctatagtaaagaatacatattctgcatattcttctaagcatctatttaatatattttctatttgttgttcttcaccatataagctataattaccgttttctaggatttcttgcaattgactgtaagagtaataagtaatttttttatcttcattttgtctaattaatgcttgttttaagttattataaattcttatgcagccttctccatctagtaatgtatcacttgccataacagtttgcatgttcttaacaagcattaaatctaacgtagaatggcctatatcaacagagaaaatagttttattcatatcatttctaggtaatgtgaatataggactataagcctgtggtaagcaagtaacatcttttatgtaaactttctttttaacttctccaaaattacaaagataactaaattcaaaagcagatccttttaaccaatcttcaaattttttactatctccttttgatctattaggtaatccaacacatagatatagattaaattcagattctttagtaagttgtcctactatagatagtaattcgattaaatgatattcatctttaattctatctctatttaatctttgcatagtatccgggtatctttctatgcatgcatctccacaaataaaatatttgccattgtattttattaaggtatttttattattcaattctttaatggtatttgctatatttaaagcttctttttcagttatattattgatgtaatttttcattattacttcagtatcatttgtcatacctattccatatccaaaaccagtatcaacaccagcaattatatttttcataaattaatccctcctaaatatgcttgtccatataattttaacataaattataacaaaaaatcaataattatcattattatttaattaaatataaaaaaccaatgataaaacacttataaaacatttaaagtttttttatgttttataattaaaataataatatttttatgattttaaaatatattaaagttatataatgattataaaacattaaaacacgatataaatgttttatggtgtgttttaataagtaaaaatagatttacatgctttttaatgctaaatataatatataaatcatatctttgattaatttatatattatgtttaaaaactttaaaaaactgctacatttatcatttataaatgtaacagctttttgttttaagagtttttaaatttttttctaataaaatgaattacataaactattataataattacaatagtacaggatattactttgaatatttttccacctacattattagtttgagatttggctgaatctgtaccagctttattactcttattaataactactggtacaaatgaactattgtttctagttgatttttcatattttgaatctcttgtactgctggtgtttggagtagttttattcttattaattatatcttcatttttagacttagaaaaagaatttgatttaaaattactatttgtatttgatttatttgaatttccttttattgaagaattactaggtgttttaactgagctattagaactaggtttaattttatcattagattttcctttatttcccgaagaaaaggaacttgatttaaaattactatttgtacttttggttgttgaagaattactagatttaggaccaattgtagtactggatggctttgatgaacttttagtagaaaaagaacttgatttaaagccactgctcgaattagaccgactagagcttgatttaaagctactagaactggagctagaggaactacttctacttcctgaagaaaaagaacttgaagaaggtctagaagaaaaagagcttgacttaaaactactactatgcgatcctcctttagcatagattacatttatatttgaaaaaattatagcaaatgtacatataaagcatactatatatttcattaaattattatttttgttattcatgatatttcgatatttaatatatagcttatatacattaaatatcactttacactccctttcatttagttatatttaaattgattagtaaaattagtttttatattgaatatttaaaaattattaaaattaaaatactaaatagattagagtttaattacttttctgagaatagaatatttcggcaatcttatctacttcgcctccatcttcaatttgctcaaactcttccccatgtattgttgtgaagtaatataaaatatacttatcttcactatctaatacgttttctaatagaatatatttcttattgttttctaggaattgtatgattgataatattttaaaatttatatcttctccggtagcgtcattggtcaatttgattattctatctttaaagatagttatattaaaagtatcatgatcacaattagatatacaagatccctctttacaccctaaacaagaattaaatttgcagtcttttacacagttaaagcaagagcattttaagcattcttctatctgtataaaattttttatatgcttttgtttaaatttttttaattcttctttatatttgctatcatctttaaagtattcaaataatcctttcccatcagcttttagatttgcttcatcgattaaatctaaatattcttttaatattttagaacttggataaaattttcttaattttagtttgtcttcttcaagcaaatcttttaaattgtctatgttaaacaatatatcggtatattgtttactgtatttttctttttctttagtagtaaattctataattttattcataaaactcatcctttctatgttatttaattaatagttatagtaatttttatatacaaatttctcaataataattctataaaaaaggcactaattaccttattgaaaagctaaatagtgtctttttagattttaaaattagatttattatattctaatctagttttcttttagtttttgaatcaaatcaagtatttctagatataaccaaactaaagtaacaagtacaccaaatgctgaataccactccatgtatttaggtgctccataataagctaattcatttatactatctaaatctacaattaaatttaatgcagcaatgactataactaataaactaaagattatacctataataccacctttatataaaggaatttttatttcaaaggccaatgataatattaaagaaaatagatttaatattagaattcctacagtagctattatgattccagttacaatttttttatttataggtccaattgatttataaataaccaaggaggatatagccattgctattgttaaaagaaccgctggtaaaacaattcctggataacttaaatctgtaaatttagaagcgattcctaagagtactccttctgttattgcatatattggagaggttatcggtgatactttaggtctaaaaatggtagtaaatgctaaaactatactaattgtaacacctataattaatataaatctaaggccggcactatcatcaatcattgtttgtgaaagactatctattttattccaagaaaatataaatgaaatagttagtaataacaacaatataaaggttttattatatgtgcctttaatagtcattgatttgtcttcatttaaaaatttacttttctttatccctttttccaagaagggatttggtttcttattcattaaaatacctccgtaaagctttattgatgtgaaatttgtgttctaaaaaatccttctaaatagaaggattttttaattaagatttgtatttttccaactcagcatcaagatctatttcattaagtttgtcaaactcatcatctaaacttacaggctttaaatcttctaatcccgctgcagttgtttcttttttacttatttttctttctatatcatcaagattaatattatctgatgatacattgcatagtatttcatttactttttgactagcttcagcagtatttaacctagcattggcttcatctctatactgcctagtttctgatattgatttttctaagtctgctaatctgctttttaatttttcagcattttttttagcttctgcatgttttgactctaaatgcttatattgtttctcagcttcaattttcttttctaaagcttttttagctaattcttcatttcctatagataaagctttttttatttttgtttcataatcttccatttgagattttgcatcctgttttttttcttctaaaaaatgtacatttcctaatacttcagcagcagataatttagcattgtgtagatcctcttccatatttcttattttttgctctaatgattctattggattttctactttatccaatgcattatttgttttggccttaagaatatttttaatttttgagaaagctcccatgtttatcaattcctttcttgtatgttatgataatatattatttcttttaaaataatttagtagaattaatatattaataatttatatataccttttttacaataaatttgcacaaataatttataatttcttatattgatctaataattctttattgtaagtatttttatcttttagcattattaatgaactattatttttactgtctttcttcatttgcttctctttttcttcattaattttaattacagaaatataatcatttaatattctataagtttcatttaattcaaagagtaattctttattaaatgaatcatgactataaattgaacttttatacacatccaataaatcaaaaatatgtttaaacaaaggttctttttctattaacaactcttttagggaaaatacaatttcatcaagtttatctaagctagatatttgtatatattttttgtttttaataattatatctgaaatgaatcttgctataattatttcatcagagaaattgcaaaaaggaattattatcaaagcattgaaacatgaagatgcaaaaagtaatacaaagtttaaccaatagtaattgccgttagtagtaataaataattctttaatagttaagccgaaaaaaaacaggtgaataatgatggcgataatatttccaattgcccggcatcgttgttttatttttctttctttttttattaaattttctttcagttcgcaaattatatttaagtctaatatctcatgtattattttattatattgttcaatttgataattattgtaactcatattaataccacctttctttaatatttcgcttcctcatttattagggtaattatttagggcaattattttatgttgttaggatagctttttaacattgttataatttatatatacctttattacaataaatttgcataaaaaataacatctatattctagaaattaataatagatgttatcttgagtcttagagttttaattattataatcgccttaagctaaatatctcaactggttgcatcataactataatggccagctatatctgaattaaataccatgaacgaaaatatagttgaacatataaagttcatattaatttgcatacttatcagttataatcttaattttttttgcaatagatttgaagctttttagtaatttattagtaggctcttcgtttgttaaatctagtagtatattaacctgatgattaatctcttgcatatcatattttgtattgttaggtatagacataatataatcacgctcctaataaataatctaaaaatatataagccagtacttcatttttagttaattctttataaacattaatatcaatttttacatttaaaataaataaaatagatttatcttcactttcaatgcaataaggcagtaaacgacataaatttataagagaaagtgaataccatgaagaagctagtgtaattatatgattgttagtgttatgtgtatttttttgtttagatgtatctttaactttctggatattatttgttaataaatctgtatcattaatgaatttatttaattcatctccatatagttcagtttctttataatcaattaatatctttaaaatatctttagctattatttcagaatctatttgggaaagcaattcttttaccgtaatactttttttattcctttttttaattttaaatccacaaaataaattcatgggtataaaaattggaagaaggataatattcaatactgttgatagaaaaagttgaaaaaataaatacattcataaaactccttttgttaatatttcgtatgtaaattcatatatacattttttgtgaaaaatattagcaacattattttttataaaaaataaaaagagaagaagctaaaaataatattactcttagttttttctcttccttagatagatttatttaacaagatgctaaaaaaaatatggttaataaaacaaatgccacacaacctaaaatcgctacatacttttctgttttgtctgattttattttatcatcaactttttttattaattgctgctccataactgaatctttttctgccataacaacaggttcatattctatcattcctactacaacttgtattcttattttacccttacccaagtcacctagttttaatggttcctttacagctttatttaatatcaaacttgaatattctccgtctttaccctttattgctgtagcttcttcaattgatgttatttctctatcaatttttttattactatctactaggattggcattggcataattacatttgtatttgcttttactggtcttatgttagtaaaacataaaaatattaaaaaaaagaaaactcttttacagttagataattttttaaatttaaacatcatatttttatcccctatcttatctgtatcgctaattatttgtattgtaacttattcccactcaataccttttaatatattatctatttgcataatttcatttacggttaagtttttataaaaaacttgacttgtcttatgattataaagtcttatttctactgtactttcttcattggcttgaatttctctataaccacataaacatttatatacacctgactctatttcttttatgtcagttttacatactggacattttttcattttaaccaccttcccagttacataatatatttcattcctggatctactatttgaaagaacacttacttatttatttgtattgtgaatcaccaccacatagaaaaaatacattctttccatatagtcaatatttcttctgccactctgaaagccatagcttcattttctgaaccttttgttatataatatttacatccaaaaatcatacggtcaatacattcttgttgagttaatttttctccattgatattaaacttgtggaaactggtattaatacaatttactttattaaacatcataagtctttcatatagccaataaaaaaatgttgtatctaatgcccatgtttctcttgcatcaaatccatatactcttctttcttccaaccattgtgaatctctacctgtattttttgaccaaccatagggtgttttgtttaaatttataatctcttttatatacttatgagccattactatcacctctttataatatttttgaattgtgacgctaaaccattctttcttctgactttttatatatctgttttattttagatttaggtatctttacataacagcttctatataacattttttcttcttcatcttctggctcataaatatcaaaattttacctttgactttttgcttatgcatagtgtaaaaatcacctttatcagcataactttctaatggattttcatttctatcatcccaactatagtcaaattcaactatttctccatctttgaattccatataccatttatgaaatatatgtttaaatttccttatttcacattgaattaaagagttataagcctgaaagtattcttctgtatagccataatacaatctacaaaggctatcacaatatttaatccacatttcattatcaccaaaattaggtatccagtaattttcaacatttgggttaaacgctggaacttcaccatcaatagaatattttaaatacatttttaaaatataacttgatgtatctgcacaacatgctgaaccttctcttaactcacataaatttcttatatgattttctaaaaaactataatttgcataaataaaattaggtttatttttatccttagaaacagatggcttgtgtaatgtgcttgctaatagttttataccttttttcaatttatgatttataaagcagtcaaaatattcaggattgtttatatcaactttactttcttttgcatgattaatcgcataaccaaacattttcattgcttcttcttctgattttgcattcaatgcattaaataaacttgtaagacatttagttatttcattatccataaattccactccttcacattaatttcattcctggatatactttttgaattatgaattgttattttactcccaaaatgcacttgattctatttcttttatattattttcttttaatattttatctgcaatgttattatcaaactcaatatttaattccaattccccagtatcatattcatggtgtaaataataatcttttattccacctttatcttctaattcttttataacttctgataacttcatttatctatcctccaattattgtattacgaacttatttttgaatctgtaaaccaattatctaaatcgcttgttaatacccatctgcatttttcatcaaattgaataccttcataaaatcctcgaaactccccattatgaaatcttaatgccttaatataagggctttttgcccagtgatatattgttaagtaatgatcatcatgtaattcacctaacccatcatcaattatcttgccatttttaactaaaactattttaaaaactagtttctcattttttcttaattcttgtattacttcatgcaattcataaaatttcattttatatttattcctttacaataatttcaaattgtacactttatttacaatgcgtcttaatatttaaaaatatatccttttacttttccccagtgggaatcttctatagtgacatttacctgtttcttcttcatttttaatctctttaataagctgcttagtttcctctaattgattttcattacaatcttttctgaaataatctttactatttaatctaacttcaactctatatctattcattggaaagccttaattcttttatttgatcctctttaagctgaagttctttcttacactcttctatttcttgtagcaaaatttctttaactttttctaaatcaaaatcatcttttaaacttatatattgaatccaatcaatcttagaagagttattatatgaggtattgattttatattttcctaaattttctttaaagtcataagtacaataatcccctttatccataatacttccatctcttttttcttttacattcttaattatttcttttttaatcctaagtggtttagttgttattacccatttatataaaattttcattatattctccttcctacataataaattcactcctggatataatatttgaaagatgacactactgtttaattaatttttcagtgtgcctacatttgtataattgcttttcatcccatacaaagacatactcaccattcgcatgaaattctggtggaagcaagtctttgaatgtgtctacgcattccacaccttctatttttgcccttgatttaacccatttatattctatttttgataagtatgtttccataaaacaacctccatttagacacatttatttcaattaattatacttaaacgcgtatttatccacatcacttaatattatttttagatactttttattttgtcttttattccctttaaatagcttataacaataaaaatttaatagtttctttgttagtggcttacttctttcaacactcattatttacccacattcataataatttcaaattatccctacaatattagtatttctattattcttctctatcacttagacactcttcgcaaaacccattttgctcaccatagcactttctacaaagtgttacatcacacatatcacaactaaattggtcgtatactgctgatgtatcatcaatttcttttccacaatcccaacaaatcatctttatacctccaatttttgaattgtaaactaaccccacttaactgtgcctttatattcatccttttcattccagttaatttcttgtccacattcacatttttgattatgaccacataagaattttttacagtttggacagaaatacgcaattcctagttccctatcatatttccataatatatttttaatcattcaaccaccctctatttgtattacgaattagttatattctcttaaaatacattcaacttctactatttttatatcagattcttctctcattacttttgtgtatggttgttcccaatactccaaaacttcttgttcagtattgaacctaattgcttctccgatgctgtcagtatcacctttcatatagtttgaatttaaaaatttaccattccttatcaatgtataaaaatactttttattcatttgaaacactcctttattacgcaaatatttcaaattacaactataatttttcaataaaataattttaaataattttatgccgtattatttgaaatacattttatctactattgttataatttatatatccttttttaacaacaaaattgcatgaaaggcataaaaatatgtgttaattttaaaaattagtttttagttttttgatttatttattaattatatattgtaataataattttcttgatattctttccctttgcctagagcttcgcatattgtaagatagttattgcaattaccaaaaatgatatctaagtagtacatcgctctatgcttaactcttatatttattattctttcttcttcagtagtatcaaaactttttatgaatgatttagataacttaatattctctaatattaaatcaaaaagttcatatttattatatattttattttctttatttgccttatttaagctatctaatatttcaataataatctttccatatccaaaatcaatttgaggctgttttatttcaggtttatccttgatttctactaaattattatttcttatatactcataaatttcatattttggattagtgagattaacgtcacagtcttttgaattcttaatcataagaaccttgtattttataggtatagagaaatccgtttgtactaatgtataggtacgtatgctattttcattatcatagttagatataatgaaaatttctttatcaatgcaaggaatatctgttgtagctctatcatcagaataattaaaatatgctacatctggaatacatctaacatcttcatataagcaaagtatcttttttacatatccattattcttaaaatacttaaagaaatttattctttgataatgaattggcttaatttttaatggttcttctttttttatagttttattttgaaaaaataaatttaacatatatcctccttaagtttaaataaaagtattattattttataagttatacattttttataaaaataataggctgctgtatgagatttatatcatacagcaacctattgtttttatatttagaggtatcaaaaaatttggaagatggggttataattccccatcctccaattgttgtaatatggtgtacatatctgctccctgaaactcccaagcctaaaggcatggggttcttaggtactatataacttctatattatctccgaaagtataatatcactaattattttccctaagacttttactatcaaagattgctaccaatctattaacgatagtataacgcccatttcaagacgttttaataacttatataccaatactacttagattattttttaatccttgtaatctcaatatttctttattgtgctatccatcccacacctaaaggagtgggctttccgcacagttttgtaatcttctccaccaaatatagttataggttcagatatgtggtcatagttgttgcggagaacataatcgaattgctttaggttgccatcatatttgggttattacccaatttattattaatggcttgaaaatcttcaaataacaatgatacatatattttaagatacatctactatagtaaagtctcccactttttcatataatttttcttctatagaatttgatattgaagctgatcctccaacaatgactaagttaccttcatcatctatattagtttcaacaaatttttctgcattagctatttctgttgtacctgctcctaatccgcttagaactagcggtgagcctgttttagccgctgctgctgaagctactaaagcatctgcaaattgaccttgcccagtttttccactttgtccccctgctgctatatatacattactaaagtctaaaccgcctttacccttaaaatattctaacactgctagattagtttgaaatctgtttttagattgagcatctgaagttatctttttaccatttacagagctaactacagaagaaggcaacactccgctaccacctaccgcaagaatctgtaatttgttttttgatattatattattttttattacatttggtatattattagtatttccgaataataccggataaccattagttgctgctactgaagctacagatagtgcatctgcatatccatcttgtccatttaccaaaatccctgttttggatttaggacttaattttaatatttcttctgccactctagcattagttccatatcttgttttatcaccatatttctgtccatcataacgtataacttgaaatcccttattctttaatgaattttccatagttgtagatacaactccagtaccgccaactatatatatttttttaacgtcttgtaagtcatttatagtttttaacacgtctgattctaatgcgcccttattttcagttagaagtattggagcatttaacaattttgaaagtggtgctgagcttactgcatctgcatagcctgtaccatttactaaaataaccgcttctgatctttggaatatttcctttgctgttttgttagccgtatctattctgttctttccattcattctctttatagaagccgcttgtacattagtaaaagaaattcctattaccattactaaagtagcagttataactgaaagaattttcttgtttttctttaacattagctctcctccatttgtataattttctatatttataattatatactatattaattcttatttatacattctttttaaaattacgacctgctttttagcttttgtattacttgattttttacatcatctgctctttgtttatgaagataatatagttcttgtataatttctgatgcacattcttcactacatactttttcaaatgtcattttacctttttcatctataacttttacttggtatatttctttacattcaccatagcattgataacaagctttatttaatcacaattacaaaattttcaatataatctcttaatccacatctttggcatttcatttgttgctctttaacatcttcatgcattaaataataattattatccacttttaagcatttgattggttcatattcaaactctgtggaaccgcatttaaagcaacttaacttcaattgcataactttcctccttatacttccataaatcataattattttagttcttgtagctgttctttgaattacggcatgaaaaacaccgtaaaattcagatttgaataatacggtgttctaataaattattagttatttagtttattcatagtataaaagcatagcttaatgtatatttatactaagatctgaaactcccaagcctaaaggcatggggttcttaggtactatataacttctatattatctccgaaagtataatatcactaattattttccctaagactttcactatcaaagattgctaccaatctattaacgatagtataacgcccatttcaagacgttttaataacttatataccaatactacttagattattttttaatccttgtaatctcaatatttctttattgtgctatccatcccacacctaaaggagtgagctttccgcacagttttgtaaatatcttctatatgttattattttcttttagtaaatattcaatgctcgtatttttagtaactattgtaaaagtttgaaacggtttttctctaagcattccaatcacagcaatatttaatcctgagagctgtttaagaacttctaacgatatctccaacgctttatatgcatctgtctcatctatatcttctagagaattaaatttgttgtttggatacttacactcccaatggatagaatgctttttatcaattaaatcaaaattattatcgccttttggttctagtaaatatatagtatcataacagggaccatgtattagccaattacgtaaattatctagctctttaaactttgattctaatattttatctaatctatttttttcaaacatttgtaagaataaattaatcttatctatcgtttgcattttaaaccatgtatttataattatacttaaagaaatatttcttttttccactggtatataaaaacttgatttagcattatcaaaagtttcatatgctattttactaatacacgcttcaatagcacttacagaatgtataatacatgatatacagtaatatctcttcgtgaattgtgtattattcctactacattgataatatagattaaaggcttggcttagatgagttgatattaaatctgatgtcaatgtttgtaattcattttcccttttcatgagatcctccttaatgtattaactcttatttagattaaatgttaatatatttatagtattaacaccgtattattcaattttcaaagaactttattcttaaataaaatttacatcgtttttatttcagattacacactttatttgtaatatgtcttaactgtttattgtaaaatctatttttcccgtaccgtccatttcaattttacctgtaactatttcttcattatcttttctttttggaaagatactatttgttatttttactatttccaatattgcttttgtgttatcataatcagcttgagttaataagtttgccccacatttagggcatgatttatttagccatttatcataatcctctacttgcacattatcatctctaaagtcacattctggattatcacatttaataccttttatatttaattcaatcgcatctttcatttacacatctctccttttaattttgattcgcattgatttgcctttatttcatattatgttttttaaaatgcattatttttttatctggtattgttataatttatatatactttttttacaataatattgcaaaaaaataatacctataatttatataggtatcatttttgcatatataaaaatctatcgaatagtagatacatcttttataataatatttgcggtgccatctccattatctctaacttcaaaactatttatatcactatatatatcttctggaatactcaaagtaatatttttattaagcttaaatttaagtgtatttactattttagttacaaactctttatctacttctataggtttgtctatattgttttcataattgaagttaataaattcttgttttagtatttcatctttaaatatttcatcggttatatcttcaatatttattgtatcctctttttttagtttttctcttaataaatctttagttttcacagcagtttttacatcatctatgttatcttttataaatttatctgtattttctactaattgccttgtcatatctctttcattttctattacattacaacctaagtaattttttataaaataattagagccatattcttcactatccttagacttcttttgcttgtctataagcattaaattaaattcttgatcttccctaataggttttataaaagcacatttttttattttagaagcggtcattggtagacctgtaaactcaggtgttatatttataccaatcttattctcaacagtatctataacgtgtatataattctttatataatccatttttaatattccgagcatcggaccatattctgtagatatagaaactatcattaagtcacaagattctatattatcattgcctttcatcaatacaaaaagctgtttggctagttctttagatatggttaataaatcattttgaccatttaaatattcctgagaaatttcttttactatatttctttcattattaaatttcgcatatcttaattgttgatcctttaaacatttttcaacatgctttaatataaatttataattttcatcatctaatcctagtttatattcatttaatattggactattagcattgctatccaaaatatgaataattgcttcattaatatttacttcttttatatattccatatgttaacaacccctttatatatagactatatataataatcatcttgtgtcttgtatttttataaataaatatcctttttaatacttattactaattgcatttggctattgtagaatttgctatagaaattacttgttgtgttatttcttcattagattttttattagccttataaatcttagattttttttcttttaatccattagcagatacagtaacttcaacatcggatgtttctggtattcttttagctttaatattatatattttattactagtgttaactgtatatgaggtgttatattcccaatatttattacttatttctagcataataagtgtagaaccactaaaaagagcagcaattaaaattattccgaataaaaatttaaatctatctaatttaaatctatcttctaaagtcatatacatacaataaacctcctatttatgcttatatatattgtatttaagcatactttcatattcatcttgtaatttgtctatttattatcatggtaactacaaattctcccatttaataaacctacttaaatgctttatttacttgtactattcctaattttaagtgcttctttatatcgtattgtttcacctaattttctacttttactagctaacttttcgacttcactatctattttaatggacttataaggcatagtaaaaatctgtgatattagtgaagtatacttaatcctttctaaatcgttggatagagatagtgatttcttgtatattctatcactttcttttaaatatttagtttctaagcttgagtcacttagatataacaattgagtatctctgataataattaataattcttctgatttatcaatacttgatttgtatatagaaattagcgatactagcgataatatggaaaataatataattggtataatatacttaataaccttattcactacaataggcctccttacgttactcatatttatttctcttaatctatttgtattgcgtactcaaaatatatcctctataacgccttcgatatatgcaatacagtctaatacccctatgtcattatccgtcaatatttctcctagctctagttctacatccaatctcctaaatattaaatgagcaatagaattatagtctattccatttgcttttatatctgtaacaattatctttccttgagcttgaccagttattaatctaactgaaccattatgtgtaataaatcccttatcgccttcttttgcttttaaagtatttcctccaaatgtttcaaattctatatcgttttctaaggtaattaactgccctgtttccatttaacttaattcctttctatttgaattgtaagcttaacaatttgtagttgctatgatataaggttctttagaatatccttgtatttctaaaacttctctaaatgtcattattttttcaactatacttttatcctcaattcctcttcttaaatcacctattccacctttgcattgctcatcattgccactcaattcttctatgtcttttctatcagtagtttcataccacatacaatcattgtctaaatcacacttttctaattcaaaataatcatctaattgataattttttataatccattccctagtcttctctaattcccaaggacttgcataccactcacaattaccatcaaaataaactttcatcctattccctgtatttttgtctactaaagttaatatatctggtcttgctttaatccattcctcggcctgttctttactatcccatttacatattttaaataacccgatagactcttctattgtatgccctactggaattacttctccatcttctgtttcaatattaattacccatttttgagattctttatcaaatttcactgttgctttcatcattttatattttcctccttttcaattctttcaaattctattacccatacccaaggattgtttttaaatctatatagccaatcgtcccatttccctaacgttctatcccatattccagcaaatccagtaatataattaggaacatgttgttttatatctcccacatatttttgattattttcacttctggttccatatggttgataccatatttgtttagatgcaccttctgatttagctccttcttctgttatgtcttgcaacctttcaactctcacatttgtaacttttaaaaatattcttgtcgcatcttttggcataaatatagaaggttgccaaccatttttatcttcatatcttagtaattttatatacatttcaccatctacattggtttcttttaatttatcattaggttttgctttatataaaaatttagctctataattcatattgcttaagctttgcactttccatgtttctcgtacccaaagaatatctcctggaagatatggagctttaattctttctttaatttcagaatctaatatttcttcaagatttcctttcccaaataatgcactatcaaatgtagctccatcttctgaactagtccctaaaaagtcaagcccagaaactttttttataattcttctagtacaagtttttttaccttctaaaatagctttaaccatttctgtattaaaaagtattggtttttccatactacttcaatcccttcacaataaattcaatcatggaactaatatttgtaatacgatttatttattgagtattttttctaataaaacttttagttttatagcatcttcatattctaaatttgatttaaaacctcttttgtttctaccaacttcatgtagtaaactcataatactttcttgtaattgtattttgtgaatacattccaatagcttatcagtaacaatatagtaatctgaatataagctttttaaaagttcaccattgtctaatcttatattccctttaggtgtctttttaactatagtaaaatatttaatataataatcatcaagacctattccgcaacgctcaatacaaactaatttatcattaggttttaaattattccatgctttctgtttggtttcatcacttattattggtagttttaaatctttcattgtcccctccttatttctgctgcttcacatttaatctagctcctgcagctgctatttgaattgtgacattaaattatattaaacatgtttaaatgattcatagtactttctaatctattgctggctagataaattattgtatttttttatggttatagattttcctaaaatgaaagcaactcctaatttacttagccaaaaataacaatttttattttcactattaaaatctttttcagctaaatctttagcaactaaatcattccattttttatcgcttgtactagaataaaatctatttctatagggcttttttccatagctaagtcctaaagcatgtttcatttcatctagttgttcttcagtaacttcaatttgttttttaactacttttaagtatttatctaattctttttgtgttacatagtaagtacctaatagttttttaccgcttgttacaagtattccatttcttatatcagttctaagtcttgatattcttatattttcattaaattctatatcttttaatgtatataatttctctcctaatattgtaattggcatacatttagttaatcctaataacttatttaatctctctttttcaattaatacttttatatttttattaaaagtgtcttctctttcatagatttctgatattcctaagagatctagaggtataggaatataatcactatttttatattttgttatttcttcttctgtaaatctacgagctaatcttaaatctgagctatatccgtttttacactctttattgcccaaaaatacggcccattcttctccatatacatgattatgccaattgtatgataatagatataatcctttttcattagaattttgatatgctttttgtgttaattccttaatatccatcttttctatctcccttatcttttattagtgaatttttaaaatttaaatgtttgcttaatgttataatcttttctctacgtttttacaatataaagaaaatcaaattttatctgaaatttctccccaatagtcgaatttttgtttataactacagccttttaaattaaaatcttcttctccaattttaatgtgccttatttttttattactgcatttttttaagtatttatcattaatataatgtctatcccaataattgatcttcctactttcaaaatcaattccatacacccaactaggcatatatctttttatttttcttagatgattgagttttctatagtacatttttttttggaatctatttaatttcaatttagactttttattattgagtatatctttatatatataatcatagccaagcaattccaagatatttttaatttctcttatgttattagggcaactttttagaaagtcttctatagtatctaagtcttctttatctaaatcatatttttttattattgttaaaatttctctagagttcataaaaacacatcctttgcatatctcctgtataatatttcattacatgttaaatcctttttcatatatacatatttttttattttaaaaacaaaaaacaggaaaattaatttcattttcctgtgttcttatattttacagttataaggttaattttttagagatataaatttaattatttaacaacaaaggaaatatcatattgaccttcttttaagttaccaactaaaatattaaccatcttattaatgttttcttattgaagctatttatcaatatggcaaaaacattggttactttaatcatcagatgaattccccaattactttacacacaaaccaagccttttctgaacttatatggtgcaagtaactctactttaggaacctttttaagttccttcaaagctatatacttacctttgttttgtgtgccttttactgtatatatcttatcttcatacttaaccaaatctcctggttgataaaagtatcttttagttcttattcttctttgaccctttgatatttttatacctctatattttcttagattttctgaattaaagcttttattacgagtcctacgcccattgaaaagttctgctccacttactttcgtattagttcttatatctattaccttagcatcataaaacttttcaagtgagcgagaatttcttttaatttgctcaaatattaaaggttttactctattttgattactgcctcctgcaatacagaaagcatcattgtaatttgttttctctaaatttagagcaatcctattatgtttagttatatatccataagtgtgcttacagcctaaagtattaactaatcgccaccttatcattgacataaacgtagcttctttaaaactttttactttagggtgccaaccatataaaaaaccctttcccttatggttcttaggtgtatgacacttattacataatgttatcagattacctggacggtctgatctatcctgtttccaaaaaccaatgtgatgcacttgtaaaataggttcaggacttttgtttttgcaatttggattttggcacttatggccgtctctatataatatatattctcttaaattaaagaaatccttttgttcaccattttgataagctgttccctcaattgaaggatttttaagcttatgtgtatcaaaattagcaacttcaataattatattagttataggcaataacttctttaatttatctataaatctaatatggctatcatacttatgttgtatagaaggggctaaccagttttcagaacgctttctgttatcaaagcgaggcttacggtaacgtaaacgagatctacgttgtcttctatacatagctttttctttaagacgttctgacatacatttaagaagcttaacttcaccagaaattagttccttttccttagtaatagcagaaaaccctatattaaggtagccgctatcaatacctaatgtaataggttgtacaaaatcttttgtattatataaaagtttaatggtaaatggttttgaactaaccactaccgcctttttaaatttaagtaaaactcttactttagcatatctattggtaggcataagaggtttacccttcttacttaaaacatataccattaagggcacacctcttttaatcaataaaatagtttaactataaaacactacctcaaagggtaggtaagtccacatagccaaagttatacaaggtttaaatagtagcaacacttcttccaaccctagaaaatgtttaatcactacccttagagcctgggacttgtggagtatcccaagataactatatattcttgtataacgtagtaaattaatacttaggctaatcaaccaagcttaatgggattactcttacaagcctacgaatttatttattcgtgggttagttgactacttctcatatctaatataggatttccaccttgtacctgaggtactttaccatcccatttctttactttttcatattctacaattgtgctatttaatgttgattgttttaatttatttgcatctgcttcggctttagctcctatttctgtaacttttgccttagattctgcatctactttatctttttgtgctttaattttagcagtttctaattctattttttgcttttctagctgttgctgtgcattaaccctttcttgtatagctttattggtttgttcatctacattgattctagtaaaattaacactgtcaattattattccccaatcctcaaaattcttttttgaatactcatataattccttatttaaattacttcttttctccccatatatatctaataccgaaaatttagaagatacttctgtagcataagctttcattctaccttttatatgattttgttctatgacttttcctttttgccctttaaatcttgtaaaagtttttggtagtttatcattatcaaaatgatatgaaaactctaaatctacatttaaatttttaccatctttactttgtattaaaaagctgtcatcatcttctgaaccttcttttttatctttacttaaaaatgcttgttccgtagcaactgaatactctacgacttttttaaatggagatattaaatgccaaccttgacctaaagttttatcttctactcccccattcatactataaacaacacctacatatcctgccttaattttttcaactgatgcgaatagtgtaaatattcctgttgtaactaaaattcctgatattaaacttgataaaaatctctttttcatattatttgctttcctcctcatcatttctgaatattttatttaagattttttttattaaatccaataacttactacatattggtatcaaaaatataaaggcaataattcctatcaagaaaactagtagataaaaaactacattcattgcaaacattcccccttaataacttcattttctatattgttataatttttatatgctttttttacaatatatttgcataaaaaatagaataagtattaaacttattctatttgacttatatattagattgttttcatatttttatattcatattcttgttttacttttttcttggttgcttttatgattcctttacttataatttctgacataatgtatacttcatatagtctagtattttgaagcattataaattctataccattaccagataagttcactattcctgtaatacttatatctccaacagaaggcaaatttttattaagagccgaacctggtgttagtggtttattcttaatttctatattccctatgttatcttcattgcctaaacaaacatctatagctattatatatggatttttatatttagaatttattacagaaatagtttctttaaaatttttagcatggaccgggtttttcaaagtaccatatacaggatagcagcaatttgctttagttaagaatgttcctactaatggtcctaatgaatctcccgtggatctatctgttcctatacatataaatactatattttcttcatctctaatacactttaatatttcattgcttaatttcataatattatattttttgttattagaatgtggtattatcataaagatttccccctttagtttttagtagtgttaactataattaattaaaaattattattttttaatttactttgcataaacaattggtaaatatttaaaattttacatctactttaaatattttttgatttattgttataataattgttttatatagtatttacatatactttgaaaattttttttatttttataaaagtaataataattatatgacaatataaaagtaattttaaaagtataaataacagtattatgtaaaatagaaagaggtgtatgaaatgataggatctattataggagatatagttggttcttcatatgaattaatcaatacaaataaaaaagattttaatttatatagaaaaattagccgatttactgatgatacagtattgacaattgccaccgctgattgcttattaagagaaggaagctttaaagacttttataggacacatactcttaaatatcctttacgtggatatggaagtaagttcttggcatgggcttattttaataagaaaaatcctaattatagttttggaaatggtggggctatgagagtatcccctatagcttatatttctaatgatttatatactgttttagaaataacagagaaaagctgtatagcaacacataatcatcctgaaggtattaaaggtgctaaggcaatagcagcatgtatttatctggcaagacaagattgttctaaagaagaaataaaacaatatatagaaaatgaatataagtataatttaaatatatctgttgaagaattttattctaaatataggtccaatgctacttgccaaaatagtattcctcaagcgatagttgcttttttagaatccacagattttgagagttgcttaagaaatgctatctatattggtggagacagtgatacagttgcatgtatggcatgtggaatagcggaagcctattataaagaaattccttatgatatatttgaattttgttttagaaaattaaattataatcaaaaatctataattaaagatttttacaataaatacattgtcagctccactataacgaataaaattaatgatttaatgtaaaaattatatttttaatctataataataaaatggagaaggaattattaaagttaaaaaatataaaaatagttttaagttgtgtaaattaaaatttcgcttaatatataaatatatggttaataaataacctactaacatcctcaatgttagagttttagttttaaaagccacataaaaaagaagtaattaagtaagcttataacttaattacttctttttctatatattttaaggttcttttaattttgttaattatacttcttgaattttatctactattcttttaccgtcactatttattgaaatattaacttgtataaacttatttttatttaatgtttcttctgcatattttttcatgtttccgctaaataaatctaaaaaatacttatgccagtttcctttactataaatagttcctaatacactacttcccatattcaatgcagacagtaatcttaatccatcatcagagttttgtatttcacttattataagtctactatttttagaattattaggtacagtaaatttactcaaatttagttcttttactcgttcaaaagccgttatattaacatcatcttgataatctaataatgaattaagcaaggtagtcttaccaacaccaattctaccagttatgattatatttttattttctctcatagatttagcaagataatctgcttcttctttagatagacatttcatatctataagagcattaaggtcaatattgcttatttttttatccataatatatttacctccgttcttttcatatataattatcattactttttttatatacatttgtattaaaatttattttttattgtataaatagataaaaagattattatatagatataactcctttaattttatagtttaaagccataaactaaaaggtagcaagactatatagttttgctacttttataataatttttttatttctcttaatttaatagggtatcccaaacagtgcattatttaatcattgtttaagtaaatgtagaactacaagtatttcataacaattggaataattatattatgagatttctcggagcatctattgatgaagtcctcaaggaccttttcatcaacaaatctgccatcaatcattaaatataaaaataattgatctttcattacattaatactctcaattaaatagtctatttcatgaatataattctccatattattatgaaaactttcccactcgcattgttcgatttcaatggttggtgcatgcggaacaatacaagatctgtctcttatatcatctttatctgcaataacaattacatttctactatttgaaaacattgtagcaattttacttgttgcaaaagcaatgccctcgcctctctttgcttggatagttataatcatatatttatattcctctttcttttataatttatatttttatttttgggttcatttttttaaaactcatttaatattgatttattatattgtctaaatctttttcacagatagtttctttttctattaataattcagctattgattttaaagtatctatattgtctcttaatagtttatatgtttcatcatatatgtttttagataatttagaagcctcatctagtattatattattatctacatctaactgatataaattaagcataccaaatttctcatccataccatattctacaatcatttgttttataatttcagtagcttgttggatatcagcgctagctccagtagtaactttattcttatcacccaataataagagttctcctattctaccaccataggctagtttgactttattcttaagttcttgtattgagtataaagacatctttttaggaacaatcatggtcaccccaccagctccactagttgatggtgtaattgttactttaggaatatccattcctgtaagtttacctattaatgcatggcccgcctcgtgccaagctactaatctaatatcatctttatctcttttttcatcttctttagcatggccttttaatagaattttgtacatagctttatctatacattctgtgtcaatattatctttattatattgaatagagattagaacagcttcgttaattaatgattctatttgagctggagaaaatccaatagtttgtttagctaaatttgtaaaatccacttctttattaaaacatttatttttactataaataccgattatttctagcctttcttctggtgttgatggcaaagatacacttatatgtttatcaaatctaccaggtcgtattaaggcctgatctaaatcttctattctattagtagcggcaataactaaaataccttctgatccattaaatccatccatttctgctaatagagcattaagtgtttgtctatattcgctattgtcaagatcaacatctctttttctaccgatagcatcaatttcatctataaatataatgcaaggagcattttcacgtgcttcttcaaataagctccttactctcatggctcccattcctgcaaacatttcaataaaatctgaaccattaatagaaaagaatggtacatttgcttcccctgctaaagctttagctaataatgtttttccagtgccaggttccccgtataggatagctcctttaggtaattttgctcctttatgtgtgaatttttcaggatcttttaaaaattctactaataaatgcatatctttttttacttgtttcaatccagctatatccttaaaagatatttcatttttagaagtatctgaatcaattcttttattctttatttcacttttattatatatagatttaatttgagatatcataaggatcccaaataaaatgaagataatctcttttaaactttgtattaaattttgtttatgcatctcatttatttcaatattatattcaagcaattcttttttaaaatcatttgtttttggattatctgttatatatttattatttttattatttatgaatacaaaattatcatccttgaaatcaatgtgtattttttttatttcattatttttcatttgttttacaaagatattataagaagtctttgtagcatttagattcacagcatatgattttagtgttggtattaatatactaataacaattaaaatacatattacatatttatttatatttatttttattttcattcctcaacaacctttcttatcatagctttgcattaaaataatcagatatttatcattgaatatccgattattttaatgtacttataagcttacttttttaagcctttttgaatatttatatatttagttctccttttttgtatttcaattaaattttctttgtactctttatctgttgttaaagctatagcacacttaagcaaataattattagaagggacctttttatcttttattatatttataagtttattacatgtaagatactctttattagctttcttactttttatatttataaatgctttattagtaatgtatccgtttagattcatatcaccatttaggttaattattaaaaaatgttttttgtttcttattattttaaaattctccataattactcctccgtataaataatctagatatttttatatatacatatttaaaaataataaaacattttttaatttcatattgtataaattcaattttcgattattatataagtataaggttaataaataacctaaatcatccatccatatattttagtttaaagccaaacaaaggaagcagatagttaattatctgcttcctttatttattatctactgacttttaaggctttaataataagccactatttatgatataagtatgttggttattaaaagcaatatgtttcagggttatctttcatattttttacaataaattatttccatatcattttctggtttattgaaattcgctttaaattcagaaattgttatatacattttggtatcattgctttttataaaagtatctagttttttatttattttattatctgtttgtaattttattatattatgcagctgcgcaatattaatattagtttcattaatagagttattatttagagatttaacattaaaattttgtttgtttttcattaccataatagcggtatctatttttatgctatttttatttaataattctaatgccatattagtttgattatttttaaataaatcaatactgctttctattatatgttctttcttatttttttcgtaattgtaagtttcagcattcagtatattaatattgctaataaccataaaaactattaaaaagcatccaaatagcagaaaactcaaaccagaacctttattattttttaagcacataatttcatcaccactattctataaatttcatagaagttatttctattttatgttctgctgattcattagatattatatttactaatctttgagtaacagcagtatttttttgaattaatattgcttttattgtagtaccaggtgttaatttttcattgtatatttcagtactatctatttctcggattaaatttttatctttatcatatatttcatatttataattatagtctcctataaaattaagatatcttttcatttctttattaaaaaactcgtgagtactatttctaagctctttattatagcttatatcttttaattcttgatacattaaattatttagattacttctacaatgcatttccatttcacaataatacatatacataaaagcaaatgtacatatggttaatactatagtactagataatataacagataagccaccttttttattctttaatattttcatatacattacactttccttcctataataagttttatattcttttatatatacatttttatagtaaaaaagcacctatttaaattatttaaatagatgcttttaatggctaaatttacctgaagtaagtattatttaattacacttggttgaaattcatccataatttgtgtctgttcctttacgatattgttatttgaatcatctccaacttttcgtacagactggccgttcggatgtatagcacttataaagataaataccgtaattataagtaataatacaacagatagtaattgtgatagaccaccttttttgttttttctaatttctttcattttattcatcataatttgttacctccaaaaatttgttatagattaatttatttaaactgaataatcttcagttttttattgaattaatatttaatttatggtagatctggaaggtcaggtattgttggtaatcctaaatcatttatttgttgttgttcattttcaattgctgctacagagtctttaccaacattatcaattgaacgaccattcggatgtatagcacttataaagataaatactgtaattataagtagcaatacaacggataatagttgtgataagccaccctttttgttctttaaagaatttttgaatttttttaacattaatattacctccgcgaaatttaatcaaaatattttaagaaatcatattcaagtaggtacatttatttattattacttcttataagaatcgtacctttttagcaaaaatattttaaaaaattatatttaagtaggtacatttatttattattacttctcataagaatcgtacctttttagcaaaaatattttaaaaaattatatttaagtaggtacatttatttattattacttctcataaaaatcgtacctttttagtaaaaatattttaaaaaattatattttaagtaggcatatttatttattattacttcttataggaatcgtacctttttagtaaaaaaaaataatcatcttaactttaattattaaagttaagatgattatttcaattattgtttttatctattgatactgttctattgttattgattttaattaatttatttgtatttctagataaaacaataaagttacctaacaaataagttgttattaagagtattaacactacagacaactgatgtgataatcctcctcttttattatttagtatcttcatattatcatctccgtattatattaaaatttcatattttgaacttggtttacactagataccgcaaaattaacaattagcatcattaataatactgttcctatagtaaataataatagaattaatccttctttattttctattttattttgatattctaattttcttattttatctatattttcattgtatttttttatgttatttaaggctaattctttattactatcttctatttgtcttaataaagttattattttatttatagcttgtttatctttatctaacataaataaattataagcttcatccctattcatataatacgccatttgaaatttttcaagtaatggttttaaatatttagcgttattagtcaatattgtcattaaaccttgagctgtaatattaagattagagcctattacagctaataaattaattaaatataattcttctttttttatttcttcttttcggatattagctattgtgaatagaataatatcagggatgaagaaactagatattacaataattaaatacaatagtaatctttttaatgaatacaaatggtttatcttagctaaatcatttattactactgaagatatttttggtgcatcttgaggggatataccaccttgttttattaatataacttgtattttagcatctgcactatttttatcatcaatattttttatatatttagttactaattttatattttctttccttactgtaggattattatatatactagttttagcatattcgggatatataacgttgttataaattttttcttgagacaatatagtattagttgaaaatattaatattgcaaacatagatacaactataattgttacaatttttagtgaatagaaacttattaagtcaatgtttagtagtgatttttgtaataattttatatcttttaaatattcttttgtatttttcttaggagcaatttttattgcgcattttcctataattgttctctttaataaaaaacgtccttgttttatcattgaataatagtaccctaaaattagtaaagcgaatgaaattgcaattaaaataataatcttatacatctattttatcccctcctctttaaaatctttctaataaatctattacaaaatataataatataaaatacaaagctataaatgtaaacttactagtggaaatagatattcctgtttgttgtaataattcagcagggaataattttaataataggtttttagatacaaaagaacatatgatcattacaatactagctaatttaaatttaaatagtctttcagttatccttttataaaacatattttcactttgcattgtagtatttatgtctgtaatttgtatattaagttgttctatattgccaccaaactctagataactttccaatatttctgttaattgatttacatatatgtttttaaaagtatctttgaatgtggaaaaagcttttttgctatcatcactatttaaatataatgatagtgttaaaaaaggtttttttattgtatctgttaagttttcagatgttttatttatagtttctactacattattagttctaaataaccaatattgtaattcagtaaaagcgttatttaattcttttatcacttttctatatttattttccataatatttttggtaattacaattggaatagctgaagataaaataatgtttaataggcttgtataccatatatcattaataaaaaagcttaatattatattaataatagaattaaataagattaattctattattaaataagatactgttttagatttatttatatctattgtaaataaatttaatctattttctatacgcctttgaattttagataaaattatagatctatcaatatttttaataaagaaaaatttttttatatttattttatctagcatttgcaagcatataaaaatacttacagatgtcagtatactagtgtagatcattaaattgttattcatatatataacaccatctctttcttttaagagaatatatcatctattatttttttattgttttcatcaaattcaaattcaaatgctctttcaaaaaaaccatctgatattttatttacttttttaaattctttatttttcttatcatatttaaatattgtatttaatccataaggtttttctttattcgatttatcaaatataacttctgtgatagattttatatatctttgtcctgtttttctatttataccaagcattattaaaaaatctacagctcttgatatatcatataaagcacttaattcattagtatatgtcccattttgcattagaagatttttatagtcatatataaagtcttctggagaaactgtatgaaatgttcccatactacctttattttgtctggtcatactatttaaggttattactgcttcctgtggacttctaacttcacctgtaataattatatctctattcaatcttaagcatgtttggaaagcatcatctggagttttatatgataagaattgtaattttttaatatctttttgagggtaatatctatcgggatttaattcaaacataggctctaaagttgctatagaaatattgtctggtatagatcccattaatcttagtacataagttgttttaccagtaccttggtcccctaatacaaatatatttggtctacctggcattatattatctaatgttgtttcaatgtcttcattactagttttaaaatcaattaattggtgtttagttattaacgtagcggaaaaatatcttatatttaaagaataattatgtgaataaggtggacataaggcagtaactctttcaccatttaatctttgacatagtacctcaggattatcaggctttaaatcaagttttggtttaaaagaaatactttttttaacgacctcttgatacattttttcatctttaaactttaatttaggaattcttttccttacaccacttatttgcaatgatatataatcataactattggtacttatttcatttaaacccgttatgtttccatctgcaaaatcatcaattactgacaatccatatacttcttgatatactatttgtgtcaatttatcttttctaatttgtatattgtcattttcattaataataaatttattaaatattgatataaataatttatttgaaccaacatatataggttcgaaataatttacatgatattcttttattaatttatttatatcctcatcatctacattttctgatatatatctattaataattgctttaatagaatttttacatgtaatatcacctgcaattgctttggtcagtatagttttattcaagtttatctcatttattgatgcggatttgatgaaattttcctttatttcttttaataactgatctaaagtcatagtacgctttcctttctaattttttagttttatttagaatatgttacatttgtttttctggcatttttatctgagtattttaggaataatagattaccttctcttcgagcttgttctatagattggatttcttctaagcttgcttttacaacaagtaacgatggtgttttttgaccttctgactccccattgccaatatgttttactatattccctgatgtatcggccatatattctacctttaatttcgcagcaacaacatcagtagattttacttgtttagttttagcattattattttttgggtatacaaccataacatcaatgaaatcattactatttatacttaaatcacttaaattttctagctttattggaattgaatatggtcttaatgtgttattttgattttcttttaaagttacatcatatttttttatttgctcattaggctctaatttatttactgttatcttacctattaaatctttttttacgtttatggtatttttggctatattatttattggcattattttttcttcaatatcaccttcattgattaactcaccttcattgattactcttttagcaattattacaggtgcttttgaactcttgtttaaggttggtaaattaatatttgcatattcacttacatagtacgctcctgcaatagccattagccaaacactacttgtaactaatatggtgcttattattttattcctggtattactactcatttttttactcataatatatttacctccgttcttttcatatttaattattattactttttttatatatacgtttgtattaaaatttattttttattgtataaatagttaaaaagattattattatagatataaactcctttaattttttagtttaaagccataaactataaaaaatgtagcaagaacataaatatgttcttgctacattttcattatgcttcaggagatggaattgtttcacctaaatccttaagttgtttctgaaatttcaatatttcttttattatattttctttatttttagtggtaaagtctagctgatttgctttagatataagttcagccatttctttttcaccagctaatatattgttcttttcagcattttctttatatttagctaatgtttccattacctccatataacttttagctttgtccattctgttcttatattgactattattatctaatctatttattgctttttcagcatctttatataggtcctttactacatttaagttattcattatatcagcgtagtttatatatctgtctaacttttccactgcatctcttgcttgtattgctaaatctatctgtgatactttattagttgtgtctagtcgcttttgcaattctatttttatatctgaactttctaatttatctatagctgcttgcgcttcttctattgctttaggatcttttgttgctatagcttttcttattaagctttctatatttcttacttgattacgttcttcttgcttattttggttttcttttcgatctatatatggctttaaagcatctaatactctctgcaattgagctttttcacttttatatatagttgtatttagttcttctaatgcttttttagcatattcataatcttctttatctaaagttgattttgcttttttaacagcattataagctttaatataagcatccttttctgctttgatttgtttttccaaatcatctaatctactagttaaatcatcctttaccttaccatctggtaattttgatactttattctcagcatcttttatgtcttcatcctttttagttttttcagctttttctactgcatctttggcctctttttcttcttttagcttttgttcttgatccttcttcttatttatcttgtcttgtacttcatctaatctattgttcaaatcatctttttctttaccatccggtaatttatttaccttttctctagctttatctacatcatcttgattttggctattttcagctttttccactgcatctttagcctctttttcttctttagacttttgctcttgatcttttttctcgtttatcttattttgtacttcatctaatctgtcattcaaattatctttttctttaccatctggcaatttatttactttttccctagctttatctacgtcatcttgattttggctattttcggctttttctactgcttttgttgcatcttctaagtttttcttaccttcatcttctacattaacgtttatctctgaagatgaactattttggtcattcatattgcctgcattatctatagccttaacctttatcttatgagcacctggagataaggttacttctccagcatatcttataaattcaccatcatctattttgtagagaatttcttttataccacttaaattatcagtagcagtaatagtaagtttatttcctgctacatttatactattgattacaggtaattcttgatctattttatttactattatttctttactagttttattaccaacttcatcttctattattattttatatgttccattaacagcttcagataatttaatatttatttccttgttattttcaccagttatttcataatatacatagtcataaaatccatttttagtataagtacctgtagtcatttctgaccaattattaatattaataacatcattatctatagttactttactaatttttttattatgagtagcctttatatttatagtttgtttttctttagtccatttacttaaatcagttaacacttttattattggagtttctttatcttttatagtaactttaaattcagatacgtcactttcattacctgccttatctatagatttagcataaataatattttctccagtaactaaattgtctaagttaaaatctttaagatctatccagttaccattatttattctatataaagtttgttttatacctgattcattgtctttaccttcagttattttaatactatcttctattctagttatagaaggtttagtaggagacactttatctatattacttacttttaattctttagtcttagtattgccagcttcatcttccgctacaaagctataagtaccattttcttttatagtaaaagttcctgtatctccatttacaacagttccatctggtagctttattgacttaacttttgtgttatctgttgctgttacttttactgtaaaatctttattagtccaatctgatggtattcctgttaggtctatttctggtgcttctttatctttagactcagtatcatcaaaagtaaaatcactttcttctctcatatcagaagccgctgtacttgttaattgagcacctgttaatttaccatcaaaatcatatagtgtaccatctttcataattataaatttcttatcaccatttttcccatcatctgatactatagaaataatgttattataatctataccttttgataataaatcaccgcagttctttacactaccatatgcttttgttgtattgtctttcattagtataaacgttcctgtttcatctattttaactagagtttttattagtttaccattaacatcatttaaaaaagataaatcaccattatcgtcggctatcataacttttccattcttaagccataataaattgtttacggatttattgtgaagtgtttctaatgtatttgtattttttattgacataccttgtaatgtatatataaagttatcatccattagcaggaatctattagacaatactttctttaactttttaccttggaaatctacttgtgtgccatcaaggttttttatagtaccatctttcattaaaaataaatcatctgttacattagttgatggtaatactttttcaacatcattcatattaatagctgtttctttttcaaatctatttttatcaaaataagttaatttaccatcattcttaataaataaaaatttatctgattcattgttctttttatgatatacaatagtatcattaaattcagacttttctattggaagcattctttctttgttatcattatctatataccaaatatattcatcatctttttccatcataggcacaagtccaatatcttcaatatagcctaaaaacatatttttaattttagttccgtctataggaactgttgtaggttgtgtatctgtaaaattcttataatcactaaccataccataattatctataactactattctaccattagaaaatatatatttggatttaatttcactttcgtcaattatattattaaaagcaaaagtttttttgctattggcatcaaaacctccataattgccatcaatacgtcttttgccataataggtattagcccaactaccatacttttttatacttgatgtattgtaaaatttatcaataaatttcatccaatactccatgctaatgtatctatcccattcattatctaaatctagtgctcctttatctccaaagtgggatgaaccttctccatcgttaccaccagttagaagtctacatttataatctgtgccttctatgttgaaatccttaccagctactaaattttgagaattaagttgagaccatgttatacgtttaatcaatgccctgtcagatattagtaaatttttatctccatctttaatatatatccattgtaatttataatcatcatcgttatcagtattttttatttcaatatttcctccattatattcaataatatttccgttaaaacttacaggatcagtgggcctttttatttttttattattaatgtacaaagtaccaaatttaacaatgtcaccagattttttattagatataagaggatcagaatctaagacttcaagggcaggacgccaagcaccgccattgtaattataacgaccagctgcaaggtaacgagctccctgatttccacgataaacatagttattactttcccatatagctttgtcttgcacccatgaaaatacattgtaccagtgccataatttattatgtatcgaatttttttgtttatcttctgcatgccaatcattatcagaatcatttggtattggcaaacccaaaatattattattaaaatcaccatttatccattctacattaccggttaaacctttaaaattatctgctgcgaaaactttattatttcttacaatcctaataccattatcttgcatatctatacttacaggtagagatagtattgttcctagtgcagttactcctataagtgcttgtgttatcttcttgtttattatttttttatcatatggcttcatatattatcatacctccgaaatatttaattagttttttattattacaattaattattatttagtattttaaaaaccgtactactttctaatcaatttctaaaaaatatttatatctagtttatatacaaaatcttataaattaaaaacattttatatctatatatttatatatatctatctttttgttagggtttaaaatttgtaccctattgaaaacataaaaataggcaataagaattgatcttattgcctatgaatcatatctagttttgcgaatgtttgattttctccacaccatgaaagtttcattgtaccagttgggccattcctttgttttcctactatacattcagcaattcctttatcttctgtttcagcattgtaatattcatctctatatatgaacattattatatctgcatcttgttctatacttcctgaatctcttaagtcagataatactggtcttttgtctgctctaatttctggtgcacgtgacaattggctcaaacatattataggtacatctaattctttagataagcccttaagacggttacttatatagcctttttcttcatttagactattaaatttcttattaaccataattaattgcagataatctatcattattaaatctaatttattttgcatttttaatcttttacaatcagatataatattatttaaagacttagatttatcaaatatatgcatgttgtctcttttagaatatataatattcatcgtattagatatattaatccattttttattatccatttcaggatttacttcattcaatgatattcttgatatagaacagagcattcttgttactaattgctccttagacatttctaaactaaaaaaacctatatttttattttctttaaatattaattcttgagctatatttaatgctaatgcagttttacccatggaaggcctggctgctattatcattaagtcttgtttgtataggccttggatataatctttcaataaatccattactattgctacatttggccccctacctgcatatctattacttaggtcattggttatattatttaatacatctaaaatactttcctctttattactggtattaggtaacaaagaataaatattattttgcatttcttccatttcctttattatatctacattttttgattgttccagtttatttttggtgttagttaaggttttgtaatattctctttttagtgcttgcttctttatcttctcggaataataagtaatattactatttgaataacctgcactaaatagttgtgctaaataagatactcctcctgcatctattagatcatcatttttttgtaaatattctgatagcgtggtaatagttataggggcattttgtatatataaattattcattgcatcaaataaaatttgatgtttaggtaataaaaaatcctctgattttatatctgcatctactaaatctataattgcattattgtcgcttaatagtatggctaataactcagcttccatctttatattacttaaatcatattgattagcaaccaattatatcaccacctatgtaagaagtgttacgaagtctataatcgtattccttaccaataacttctattacggtgtcacctccattgcatatttcacttaatctacctgcaatacccatattgatatttactatgtcatttaataataaggtactaccaactaatactggtaaattattatcatatctatattctagaatatcaaagattattctttcatcagttggtgtattgtctttcattaaaaaattatcaattattagaacttcacaattaagtgcttctttttctgttgtagtattaattttagttattctatcgttctttattttatctactaaattattaaacttataatatcttacatctatatttttatctaataatattttacctatgcttgttaataaatgtgttttaccacatccactttgacctaataaggctagggaatgggtattattattattaaaattatttaaaaatttttttgaattagaatataatttcatatatactttattttcagcatatttataattattaatggaatatttttctaacatgtttaatgtaaatccatgagaaattaatactttttttcttttcttttctatttgacattcacatataaaagttgttccttctgtcgtccaaataatgccagtatctttgcacttttcacaatcatattcctttatactgcattggtctaatataggattttctttagaaccatattcagctaattctaaaattttatctagtagattgttcttttcattttcataatttttatgtttgcacataaaatggtaccccctctttttgtcttattattgctactcgagtagcttgtttttctttttcctcatcagttaattcagtattgtatttattcaaccatgccagttcttgtgctttatgtctctcaaaatcattttcataatcattaggatctataagagtgtcctctataaattcttgtatcattttttgttctctcattttacgtatatgttcggacatttcttttgcttgtctatttattgattcaaattgggattgtttattattatatttgaaactattcttgtttgcataatatttatttggtttatctttatcccattcattcttattctttataatccccgtaacataactaggtgtccagatatttttattttttgctatatctaaagcatcccttatttgttcataattatgtttagttgctaattttaaatatcccttaatataggattgaggtatgttttctaatcctatattggcatctatttcgtctaatattttcttttgttccggtttaatatttttatatacttctaatttgttattttctctaatttctttatctttctttctttttctatgattatatagtatgcttgctacatagttaggagaggatatgtttctatcaaaagctttatctattgccttttttatatcttccaaagggaatttttctctttctaacaattcatcaaaaaataattccttggtaaaatagtttattttaaagttcttatctatcatgtatacagataattcctgtatttctctttgttctattgtaggttcatattttcgaactttatatatttgttgcggatcatctttatctatcatttcttcaggggtttctaatattttatatatattggtttgatttttatatattgtatattgttttgatttatttgctactagcattttttcattactttttctaatttgtttagtcattagtcctaatgcttctaaattttttattgcatcaataactgttgttttagatacgtcagctctatcagctatagtatctaatgaaggataacattcattacttttatttgaaaaagaagcaatgaccaaataaactattttatgcgttgcttttaattttttactatatatgattgcattatctattgatgtaaattttaatttgtaatccaatatattttcccccttgtttatgatagaattatcttctttaatcaatctatataatctttataatgacttggccaccaatctggaatatgcttatattcatcttttatccattctggcataccaaaaattgatataggtttaatttttttatcttctgttatttgataatctatcaattcacattctttaagtctttctagtgcatacattacattttcatcgtcacaatcttgtttaccaaaatatccagccaatcttaattgtatgaatcctgtgagttcttgccaatataaatcatctcttactaaatgatgagtactttcactaaaatttaataatattaaatatattattttttcatcagctgttaactgtctagtaaataaaactcctaatgggcaagagccctctcgatcacttcgctcatctaacacataaaaatctttattattatccataaaagcacttccaatcattttttaataaatttgcacattttttgattctataactaacagtactttgagaacagtttatattttgggctatatgttcttgagttttattttctaatagtaattgctctaatatatctttatctttttgattgtgaattttatttaatgactgctttatagtagtggtatactctaaattagctaattcattatttttagtatctatattgtctatgtcaaaaacaggtctttctatcttggcttttctatatgattttaaaacatactttttcatgtcattttttatacacacatatatatatccttctaaagaccctttatctttgttaaaattttcgtaagattttaatatggcaattcttcctatttgttgtaactcatctaattcagcaaaagaatattttgacgtatattttttagatattatatcaataagttcttgaaaattatttaatatagcatctatatcaggtttatcattattcaataaagaaccctccttttcaaagtgtaaatatgaacaaattgttaaatgtgttactattatataaataaaatattatatttctattataatttttaattctttttttacaacattaaatataacagttttaagaatgttaactttttttacaaactatttaaaaatttagatatttattttaatttgttcaaaataatttatagaaaagttgtttaatttatgacagcttgtttcataatttaacattgaaggacatttatcgctatttaatgctctgttttcattaattcccatatagtttaaatattttaatattttttctaatttgctttgcttagtatgttttctttttgtacacattttctttatttcttttttactttctttaatttcatttacacaatcaaacatcaattgatctccaaattgaatcttatcaacaaaatttatattattttgcttttcttttttcgtatctacaatttcagttccttctcttaattttaaataggctaatattgatttgatttttctacatatttgtgtttgggatacttccctctctattgctatttctgtttgacttttatctcttaagtaatagtctacaattaagtttttatcactttgaggtaatttatttaatattaggttaatatgacttttatttaccagttcgtcttcagcggttatatcttctatattgtctataaaacgttgctctttttctccatcattatagataatattatccaaactattactgacactatccatttcccaacctttctgatagttatctcttatgtgtaataaaatttctgtagatatgattttgtttgcatatgtgctaaagttaatgtttttacttatatcatatgtattaaatgctttccatactgctaaatgtgcaatctgtttaatatcttcaaaaccatattttatccatttataagcatatttggttattaagttagagtatttctttagcacttcttcaaagcttaatttttctatattatttttatttatttttatattttttttcattaatatctatccccctattattaataaaatatgattttatagatatacaaagccagagatacgatatactcctggctttgcataatatgcttatatagttgttgttttaattaatcttactaatgtaccagatactctttctctttcacgatctattctctttattcgaaccaaataggtatcaccaatattaggattaaagtttgcccagtttggtggaggacatagtattactattccttgttgaagctcaataaaaatgccgaaattttctatattcactattttcccagcatgttcactgtttttaggatagtttttttctactatctctattgggcttggctttagtgctttcatagataactgtaatatttgattttcagcgtcaatttctaatattttagcttgtattctatctccaacttgagcatattttcttaaatcttttatatatccataatcaacttcttttttattgatcttggtttccagtcccataaattctactactatgtcagatgctccgatagctacaactctacagctgattgtttcaccagcttcatgttttattagatctgcttttcttttaatttccatagcagctaatcttgatgctacagctattttttcatcttcttggatgcctacaactataaaatctatttcacttcccactaaacttcttaagacacttctatcttctctaacattcataacaaatgatggaagtattattttatagccatcaaaatcttgtattattgcacaatccgtaggtttttcgttaaacgatctttcttctattccagttatatgtgctgttaatattttttttgaatgtttacttgcaaaaatttctgttcctttattcattgacatcttctccttttatgattaaattttcacttgcatatatacaagaactgaaaatagtatctaaaaaattagaccttgagtatatttttttatatatacaaaattaagtatttattattcctttttaaaaaattgttgcaactaatttttcccttcatctgtatatatacgaaaactaaaaaaaatatctaaaaaaattagattttttagcatattttttttatatatacaaaattagtatttattattctgttattagaatttattacaaaaaagaacagtagctattttaattagctactgtaggaactagtaatatatctccaggatatattagttcatttacattgttttttatttgaatttttattttaattttttttactggcattgtattagttgcatattttttagcaattccttctatagaatccccatttttaactttatattctttgtattctatattgttattgtatcccaataattttttgttttctatttttatagttgctaataaactaattgttaaaattgttagcaatattgcaatttgttttttgaatgtttttttcatttttaaattccccctaattttagctattattagccataatttatactctaattagttattattactttttaattttttgttgtataaaatatagatatttaaatatataagaaataaaagcagcaaagctatttaatctaattagccttactgcttttatttttccttttagaagaaggaattgtttatctaataagccctcataaagatatatataaatatgctaaaaaattaaaaatattttatatctatatatttatatatacctatcctctagttagggtctaaaatttgtaccctatttataaataactttgaatgcatttttattacctagtcaatatatagatatttctttaattacagctacatttctattaagcttacacgtattgaatggtaaagctacaatcttattacttaaagttccatatattatgccatctactttttcatcaatacttaatatttcttttatttcttttttattcatcaaattattattaaacaaaattacatcactcttttcttttatttatctataaaagttatagatacaaaagaaaagaatcacaccaacttaataaaaaattaaattggtgtgtctttatactattttatttaattgaaaaagtcatttagtgatatttgatttgaatttttatttgattttttattagttttcttgctactagtagttttttcattttttatcatatcttctatattactatctttaatcatattttctatatctttatttattgaacttattggttctatatcatctataggagattttttgtgataagaaaaatcttttccttttgaccattcgggttcaaagtctgttatttctataggcctaaagttcttgcttaatggatgaaattcgtaagatcttttatctagaattaatggtttttgacctttcagcattagtatttctttatctgtaggaaactgtaaaatttcatctggatttaacaggttccttttagttgctcttgttgtatttttcccaaaatcaaataatccttctaagccgccgcttttactatttgaggagtcttctacggttgttattcctaataattttgaaacaaattcagctgttaataaatctgtacatcctaaaaataatttactatcacagtttcctattatttcggaccatccaaaattgggatatctattttgaagctgggctatattttggaatataacatggcaatgaactcctctagatctcattgtacttattttcttttgaaaatctggaatgcttgctatattagggaattcatctaacataaaatatacttcaggatcacatttaccactatgcaggtccgcataattgactaaatttataaatagaaatgaaaaaaatagtccacttagaaaatcaaatgttgaagtcatatctgatgttatacaaaaatatgcgcatggtttttttgcaggagcgcttagatctatatcgctggtctctgttaatgcttggacaagttggttctgaaacacttgtagcctagtccctaatcctattatcataccgcttcttacattatcagcactttggctaaacaatttgtatggctgcttagctggatgatcaccaggtagcgcactaaataatctgtccatttctttaacatctttacctgctaataaagaatacatctctcttagatttctttcgctttcaggtaattcatatataacatataaggttagtgcttttaataagttctgttctcccttttcccagaattcatcaccctttgaaccaacaggttttgtattatctattattgtttgtgaaaatacttgagcagataaatcatcagttacttcattcaaagggttccatctatgagagttcttcatattaactaaattaaatactttcacatcatatccttgactttcgagaaatacttttaaatctctcattaattcacccttaggatctgttattaccatgcttttcttattctggacaagttggcatactactgttcttaaatagaatctagatttaccagtaccaggagcaccaaatatagctacattcttattgaatttccatgtatcaaatggcagagctacattctttccatttaaagctccatagattattccatctactctatttcctatgtttaataattgctttgcttcttcttcatccatccaattagcagttccatgtgttccgttatcttttaagtattttacattgttatttattccttgtttttctttatttaaaaaaactattatggcaattaatatggctgcaataattattatagagaatacagataaccataagcttggattaataaaaaaatactttaatgtagtaaatggttttttataaagttcgttatattttaaaacctcagttatttttcctttattcttagggtctagcatatttttagttactaaaattgctggggtagtagcatatatcatggagaaaatataaagaacagtgtatataatttttctagttgatttttttaaagccttttttaaaatatttaatatattcattataaagtttctcctcttctactaggacaagtctcatactttataggaagaatatttatattttcatgtaaaactgtcttataatattgctccattccctttagacaaaaaacattgattttcttatgtgtaaagttactagcaaatgaatttaagtattccatttttgcgatatctataagtaatagactggtatagtaattgctttgatcttcatattcaaataaactgttgctgcaagtggatgcattctttaacagttgcaaaacttccatattaatatccttagagccatattcatttagtagtttaatgcttaacttccctgttgggacaagtaacaagctatgtcttcttaatgcatttataggcatttgttgtattattttaaagctatttataaagataattactttagtacaaatgtttttatctaaacttttaatctcgtattgtgcataagttaattgttttttatttaatctattatctaagtgataaacaataaattcttctttcctatcattagttaaggaacctactgtttgacatacctgatttagatttttgctagtttttactgcttggctattttgtatttcccaattatctaattctgtgtatatgccggctattttggacaattttcttgctttgcttttatcataaactggagggtttatttcaatatttaattcttttaatatttccttgctcttatatcctaaagtaacaaagccatgcttacctataacataattttcttcttttaatttcaataatctttgcttatagtattctttaccataaaaattctgaagcccccttacattcagtgcaccaaatttgttcaatgtttttaaaagctttatgtctctttcttgtaattcaaccatctgcatctactccttttattccggttttatattcagttattatttcatttttaaagttttgggtgcacctatttaaaattttgcttaccattatcaaaatgggatattatataactaatttgaaaaaggagctttactttattttgctttatacatattcttatagttttaatataaataaattggggaagtgcttttctaggagctatgcattttatatagatagtgccctactcttggaaagataggtatagaagagaatatatatttttagaatatcttttcattatatttattaaatttaagatattttttgagcatagatagttatcctacctatttacgaaagtaaaaaaatagctagttagttagatgtttataaagttatttttaaaaaaatagttatatattaaatttatattaggacaagaagcagtttaaagtaatatattatttataaggatattaagtaaaaagaataatatagtatttatatattttttttaaaagctatgttaagagaaataagaatagcaacataatataggacaagtagaaaagaccatgaaattatataaaaatataattcatgatctttaataggtccctaaagatttataatattaattttattttcatatgttgtaatgaacatctcggtatattcattattatctttttcaatatcaactccatctaccatatagcttaaatgtttataatcatcgtcaataattaatgcgctatatcttatgccatctataagaaacttaataaagcgattttctacatcggaccaatgtcttatgtgaaatttgatttttacaaatattttctcatgggttttctctaaattaagagatttaatagcatatacaatagttcctatccaatattgctttataaatgtatagtcttttttacgtatcttagtaggtaaaatgcctgcaattttaatagatatgatattattttcatattgtactttatgatttaaaacttgacttttatctagtggacaagaaaagaaagcagccttttcagtattataatttagcagggtatttactataatttgaagattgtaagttatagaatataattccctataagaatccaataattcttcttcttggggtactaaatatttagaaatgttattactatattgttcaagttctggaactaatgatttaaccttattgagcaattcatctatctttaatttattattaataatataggtaaacatattcaaatcattcaaaactcagtgcctcctaactagttaaattatgtcctacatgttaacggatttagcaaaagatttcataccatttaagaaagcctgtttatcaaaattatcttgttctttctctatattagttttatcatcagtaacagtattagaaactatagttgtggtttcatcatcaatatttactgcttttgtaaatgtgttacttaaaatgtttactaaagctttcaatgaattgtctatgctatctagctttttattcagttcaattaaagtagtatcatcattattttcatttaataattcattccttaaagctctctttacagtatctgtcctatagcttttaggaatgttaagatatttattttctaattctttttcatctttattaaatctaaagcttacaggttgggacaactttaaaacctcctctaagatatatgtatacatttttcaatatgtatacatatactgtatacaatgtagtaaatattattagtatatatgcattagttagtaatacaatttgtgtatgcaaaagaaaaataatgatatatttttaaaagatttgtatacattttattaggaaatactatttcatagagatatgtatacatatactgtatacaattttgtaaaaagttattaatatagctagactgacatgtattacattcattgtatacaacttagaaccatatgtaatgattaatcaaaaatatgaaaaatatgatatgtacacaaatgttgtatacataatgtactgtatatacttatatggctaactttatatgtattttattaaatgtatacaaatcagaatataaataactagctaatatatatagttattaattaaatattagctagttataaggttatttgatatgctatttaaattgtttaccaaattctaaatatcctatagcattagcaaattcaggattatcaattaattggcacatattaggttctattaattttagatggttgtacaaaaccttaccaccaccacctgctatcataatggaattaaaggaattttttctacttccccatagtccatcagctttattaataatatttgtgcttaaggtctttcttgccttaattagatctttttttaaatcaatgtagtctcctttgaaaaatattttaccttcctcacatagtagcattaattgctctgtattcagcttacttccatcacgagaattatctgtaaaagctttatccatagtattatatatgtttatcattcctagaccatccaaagtagcagacatttcttgttcaaacacaggttctttatccttgttaattctaaatacaactatatctgtggttttaaagcctacatcaattaagcctataaaagtttctttaattaataaagagctgatatcattattaattttagaaaaaattgcacctgcaccttgaggaaataaagtaatattgctttcttcaaactttatgttcctgctaaaattatgatctacaaatttaatagtatgctcaaagtctttaagcatatcatttaatgcctgtttttgcttgataaaatgttctaatggtaatccagtgacgatatgaattttagtatcattagatagatcattaggaattaataatcctaaagcagtggctagtaaaactttattttcttctgaattaattttattgtccctattaatgaaagatgaattgctaggctgtcttttggctaattctcctacaaaatattctttttcattgaaatattcatctaatattttgacatgtatattatctactatgttatctattgaattaaaaaatgtatctaaacttctatctttaccactacttattatggaagggaaaataactcttttattatcttgattaataccttttatttgtccatagcctaaatctattgcaatcgtatatttattcataataaacaacctccttaaaatatatataattatatatactatttaaaatttaattatgaaaatataatattattcaatttatcatatatttttgctttataaaaaagattaagttatttactacatgcatttatttattaattaaaaatagtgtaatagtatatcccaccaatataaatggaacatatttagtacaaatgctattaagcttttgccttgtaaacaaggacttaaaaagaatatatataatattcaaaacagaggatattataattatgcttaatatattgtacccgatagataaagccaaagctgttaaaatacgtacatcagctcctccaagaccatatttaccaattaaagcactaaatatatacacagaatataaagcaatgaatataattagtgcagcgcagaaattacttttaaactgattaacaaagatagagtatataataccaacagcccctaatatataggaccaataattttctatttctccttttttgagatcgtatattgaacagataaacaataatacaggaactatgatatataatataatgatagacatgattaacctaaccttatattattaagagttgatataatatctggttttagtagaaagtatttaacatttaaattcaataaaaaatctgtattattatctgttaatagtataataactttatctaataaatccttatatttagtaacaattctagaaacttcacttctggatccagcactaataattagtattacatcactatcatttaagatatcataatagcattcattaattaataaatgaggcatgtctataaaaatatttccttgaaaagaattttttatattagtaataaagcatttatctaagtattttatagaattgctatacataggtgcttgtaatattaagttattattagaaattgataaaacactttttttaaagtctttctcaagtaaaaacgttgttatatttggattctgagggaaattcagcatgaaacttaaatctgagccaccttcttgaaaatttaaatctataaataatgtattgcttatagaatttataagattatatatataagttgttttgcctattccgcctttttcagaagttatgataatagttttattattaaaattaagagattgagccttaggcattataatcttatttttaatattttttgttatattaaatttattgttatttattttttcggatatcataaaatccttatctttagctttataggattcttcttcattattaagtgatttttgagtatctatagtttctgatgatgaatgtttaacctttatgtttgatttttctttctcaattggaacaaaagtttgattttgtgtaaatctagctttcttattagtactagaatgatttatatcattcttttctaatttaatagattttttagctatattattttcattaattttcttgataaaatcatccaaatctataattaaagttgtatttataatttcttcaatattccattcaaatgaattatctataattattttggttaatttattttttaatattttactccaaatattagcagaatactccgatgtaacaattatcatgttttttttgttgtatatagctttaacattattaatagatagggttagtattataaacatgattaaaacaacctccttacattacaagtatttattataagctttagttgtattggtatagcattttgttttaatcttataatagtttcattattgaatttataaggtttatagcaatatcagatgagcgctgccatactttcaattgagtttcactcttataatgaccgttacaaatacccacattgggaatattcatatcttcattttcatataaacattctaatgatgctaaagcaatatttctgtttacatcttttaagagtccatgtacagcatctttattaatagttgctttttcatagataattactttccctatggttatattgttaagaattatactatattgttttgattgtttaaaatccttaattatatcatcttcactataaacaacaaagcaattttggaagtttttatcaagaatatcattatgaagttttctatccaatataattgtattaattaatgcgatgttttccccacaatttttacatgttccaaacatcatcgctgtttctgcttgtaaccaatactttttaggaacattaattgtgtcaccatcatcatataaataatcttgggtgcattcacattgtttttctccatttgttagagaaaatttaactaaatgatttttacacttaaagcagctaaagtcaattactgattgttctttgaattcaaaagtttgcccattatttaatcttatataaacatcattgaaattcattgatttatcactcactttcattttttatttggtaatatttcagcgtgctgtactttacatttattgttttccaaaaacgatcatcaacacattttttaaaaagccccttatgtattttatatatacataaggggcttttttttaatcataaattacaatatttattatcttatttttatataacattagttctccaatatgatcacttagattatgatatgcttttgagtattccataatagagttatttgagactttttgaatagtgcaattaatatctactgctaattcagtattattatctagctttaatttagaatctgcaacatccattattttagcagtatatatatatattttttcttttacatctgtacgcattttttctataacttttataccattataaataacaatatattcttcaccagtattaagtttcccttggaatatttggctattaggttttatttctttgtctccaaaaaatactttgtctttagtatttataattttattattagataaaattatattattgctatcatatttctttactgtatttaaagtatgcttttttttagtagaggaagatgaagaattattatcattagaaggagaacggttgttattttcttctaaaacaatcttaggattattagtagtattattagtatctattttaattggttcattagattttaatataattgctccaatcattgaaataaaagcaacaattataccaataataaataacactctaatatattttttatttttaaccatattatcaactcttccttgaaatattttttattctagaatatccgaagaagtcaaaggtttgtgtagtctttacttttttaaagccgcttggagttaattttatatcagtataaggaaaagtttttctacattctagcttaacagaattaccattttgccttatagtaatattaactccccctattccttgagaagaaaatactttattagctttgttaattaaatgagtattattgctccaattattaggtaaagagccatgtgatatgatatattgcttattggttgtatatacttcccaggctactgttctagcagccatatctgctgtttgatataacttattcctataattaaataaaattaaagcgttatattgaaacatagccataataaaagctattattaacagcgatatatatgcaaataataaactagagccttttttatttaacttaaattttttaatcatgataaaatgcctccgctttattgcatttcttcaactatttgtgatcccgatccactaacagtttgagaaggaaatagtattgctatacttggaactttataagaaacagttacctttaattctttacctatacctccacccccggatgtattaacagtagcatttttattccaattacttaatagaccagaaccataattattaacagtttgtttggcaacggtatgagaaagtgctggtccaactctagatcctgctctagctccttcagcagcagtagatataactacattttgagcagtactgagcatcataatttgtattattaatcctacgagtaatacaaaaataaatagcattcctgcggcttcaacagtaccagaaataccttgtttatttaattgtttaatgattttttcctttttcttatttgacatgctttaccaccccttgaataacgccattttttattaaattctaagacttgtcttacttcataatacaaatctttattaatgctaaataaacgggaagttacatctaaatatatagttgatttacttatattaaatgctttagcggttgctctaacagtatgcttagtcgttataatataattagcttcttctataatgcggtcttgcattttattacataaggacatataaaaatcaccttctaactttatactttataaataattattatttcaaaattattatttattttatttatatactgaattattaataaaaaaacaaagagctaggacaaaatttaaattttattctagctcttttagttagtttaatgaaattaattttaatgattctactgcgtatttgaattaaagaaatttctagcattagtagtaactgtcctccaaatacctgatacagcatcttttgcttgggggactactaatataatacaagctactataattgctaatacacctgctacttcaaccaattgtgagataccttttttattcatttttatcttttctgcgtataagtatttttttgtacataaattagcatatttatgatatatataattgtttaatttatttttcatattataaaacctccatttaagtttaaatttttacttatctataaaagttataggtacaaaaaataaaaatcgtactattttaacaaaaataatacgattttttataaaaaattttttattaatttcttagtgaaaaaagcatgtacaaattttataaattaactggtggacctctattttataaatttagaatcaatggatttataggttgtaatatgttttttaggagccttcatcatatcaccatctttactaaagccaagtaatataaccatggcaataactaaggaaatagctaatactcctaccaattctactgtatgagaaatacccttactattcatttacaatcattcccttcagtaatttaatatttcatctattataattatagatacaaaaaaagattatacattaaactaatgtataatctttcttatttacattccttgcaatttagtcatttgtctaagtaaaggcactaaaatcattataattaaagggataaaataacctattaacatagggaaaaacaatgcattatctaatttatcagcatgttctgttttaatatttattctttcttcctccatatcttgttgtaaatattctaattgtttatctaaatttataacacttctatcagttttttctataattaaagccattcttaagaagtaatcatttaggcttttttcagctacttctcttaaggctttattaatatccataccagaatttacttttgttacacatagatttattagatctgcagtattaccttttttgttatttgaaatatatagtaatattggatatacaggcatacctatttggagaccttgtataagagtttctaatacagctggcaattcattgtcttttaaaaagctttccttatacttatctatgggatctttaattttggcatacaataaaatattagtacctataagtaatataatgagggcctttaaattgctcttatttagcaaagctaataataatataaccgataatatgccccatacaatagcaataaaagaaaatagttctgatacagatgttacttcaataccaaatatatttagtttttcgattgcatgcatttcacgactaattttgtcaaacttatcttctttaattacttttttaattattttatcttttaaaaatgggttttttatcttcataatagttcacaccctttttataaaatagttacttctttattaatttttctaaatatgaatactgtagttacggtataagagatacctgtaattaaagctaatactctaccgaatggctcatgtaagaaatccttaaattcgggagaactaccaaacatcataaaggccatacctaaaagaataatcataatcataatcgaaataaattttagacctgataatttggcattaagtttttcattttgtgttaatctttttcttactttagcagaatgctttatacataaatcagaaacatttgctcttttatcattagcaaacaacatggaatctacccaagtattaactacagtactgtttactctataatcaaaatgctttaaagcatttaatatattagtattactatctatttctttaataatatatataaactctccttttaatggataggctacattaggagtaacatttttaatggcattgcttaggttactatctattcttaaataatcgcctatatcaataagtgcattaataaattgtttatttatctctattaccctatttgtacctttatgttctatatatgcatatcccattgcccccaatacaatagggacaattaaagatagaatagtgttgttaataataattcctataatcaatattaatgtagctattaataaataagaaaaaataatgttttcaacatctgcgtttatacctgctttgagaaatttacgttctattttttctatatttatgttaaaaaactttaaaatgctaaatttttctttgtggcttttatctgctaattgtctttttaaatcattttgtattttatttaccctatattctttatataaaataaaacacataaaaaatataaatagacttatagataataaaaatgatattgctaataacacatttttactcattttaatgcattatggttatgaaaatcgtaatataacataaccattctcctttcattattttattcatatattttacgatttttttaagcaataaattataatatagaattatttcttatttaattttttaaattatcactaggaataaacattactttcatatttttaaagttagttaaaacacactctttccaaaattccatagggaatgtttgcatatttaaatattctgaaactaaatcatttggtagtaaaagtaaacttttaaacaattcaatgtattttattttaaaatcaataagagttttgatatcactgatttcatttataacgttaaaatttattgaaatacataagacatcattattttcaatatctttatagaaataatctatattttgtatttcattattataaaaagcataatactcattatctacaactttaaaagtacctaatttctccatatggaaaacacctcattctttctattgttcaatatagttttttaatacatattttgttttataagaattatcatcatttattccatgaatttcaactatttctttgatcatacgacctattttatttccatcatcatcttcttctaaagatagaaaaattactatatcaactgctttcgaaattaatagtcttaaagttctatcatccattggcttatgttcctttataagcatttctaaacgttctaatgctaacaatgcactttcagcatgaatacttgtcatactacctgcatgacctgaatttaaaacgtgtattaatgcatatgcactttctggtatacgaatttctgtaagcataattctatctggattagcacgtaaacaatcatttaatatatcttcataagtaataggtttttttccaccatccgcatttcgtgtttttaaataatatacgtatggtagtggtagtaatagttctcttgtatcttctaaaactgctactatatgatttttttgtatataatgcgttaatccattcataaatgtagttttaccagcaccagtaggaccaacaaatacaatattttttctctggataatagcttgtttacaatattctctgatgtcttgattttgttcaatttcaatcagattttcagttttatttttagaaatctttttaatagctggttcttttattgtattaataggaagttccaatcccattaatgctaattcatctaaagatgcagatgctaaattatgttttcttataattatataaggctcaattgattcaggaggaataattaattttacacgagagccgtccaataattcacagtcttttgaaggttcttcagtagatattgatatttctgcatcagaagcaatttttttataaataactgttacttcatctatagttaatttttcaggtgctaatttccttgtaccattttctatatacatgattttagtgcccaacataaatacatccgtaacatctggcaaagctaggtatttatctatgacatttagcccatacatttttctataaacttcttcagttattctatcaatagtgctgtttgaagctgcataagatctataagcagatttcaaaagatgttgttttattacaattcttaattgaatttttaaatcttttccattaagatctgaatatcttaacattataggtctaatagtttgtattaataattcgaaattaaaatttgttaagtctatttcttctttgtttttataataattcataactatatcacctcagtgtatatctggtataatgtgtatataatagaataaggcttaatattaagccttattctattgtatttattaggttttttaagctatttttgatattttgcattttgtttttttcattttctataagcttatttatagtactgtattgatttttgtaagaaagtacttcttcttctttttgatttatagtatttattaaatttgcattagtagcttccaattttttattagtagcttctaattcagttatttttttgttggcattatttaaaatttctactatgttattttgaaatgctaaggcttctcctaatgaagcattttgaaatgtagattcagtagctagaggttcattataatttggagtattattcataatagcttcattattttcctgaaattcttgagatgtgtattcatttgtatttgtaatagtatctactggcttagcatttgacatattattttcatttgttacttgctttacatattcatccatatcatcattagtattaataatttcatttgattgttcagctgattgttcagcaatataatcagatgattgattagaagtaggtcctatattaatttcattattatttaaaatagaattttcttcagttacaatatttttattaatattatcatttccattaaatagttcacctagatctaaatttttggtatctcccatactatcctctcctatgctacttaagtttacagatggtaaacttaagtgatcagtatttttttcatttttttgtctggatttctctttgcctttaaacagctttgaaaaaaatccttcttttttatctttattatcctcattattatattgaggaaataatgtgctaaaagtatcattaatatattttaaaaatctttcatcattataaccttgaaaatttttaaataaaggtactgtatttaatataggcaaatataattcagaatttgtttgttgtaacatagaatttgtcaaaaagtcatctttttgctttttagatgctttattaactaatatttgcattttatctttagagaaataattacttttaattccccactcaagattaccgactgctctacttactatttcataattattatttagtactaataaaatataatctgatacttcaaaaatatctatacaagaatctatgaaatttggttgtatatctactattacaaggtcaaaaaattcgtttaattgttctaatgcatttctaacatcagttgacgtgaattgtgatacataatcagggtaacctgctataactactttaaaattttcagtttttggttgttgtatagcagtatctgtatatcctgctattaaatctaatatattttttgatatatctaaatctaataatgtaggtatatctcctggagaaaaatcaaattctagtacacaagtttttagccctcttttttctgctatcttagctaatgctaaactagtagttgttttaccaactttacctgaagggcaataagaactaattatcatttttaaaaatcacctaccataaaattgtttttgaatatatatagcatatatactaaaagataataaattatttctatttagtatttgcatttgacatatttttttcttttgtagaatttttttgaggtaaaattataggtttatattgatcttgttttaaataaggtacaattttagaagcatttgtgtctattgtcttaaatgcaactaataccttattattggcattatcatcattttctttttttggtaattcttctatacttgttataattaagtcctttattatttgagggtgttcattagaattattttctattaatgctaatgctatttcatcacctgtactaattaacttagcatcttcacgaggcataaaaattgtaagcagcacttcattagattttaatttaattgcagtatctccaattatttttttgggtataaaatcattttgtaatctatcaacttttaatgatttaccgacgatatctttttgatttaatactatatcaggtaatacatttttattagatatttcttttgtttccacatcctgctctgtaattattttgcctttattaatatcattttttagcacaattactttagtagtgccactaacatttttaagtattatataaaataatacaaataaaaaaagaataccaattacaccgaattttaatatctttttcattctactaaaattctagttaagaaaatttagaaaaacttaactagagcctccttctttgttttttaatttattttctaaatttttatttgaataataaactaaatagttataaaattttttctattataaatttctcaagtatagataataattctctattgcttaattgattagtattttgaatatttaagcctaataaagtaaataagttaatgatttgcttttttaggtttatatcttcagaattaattaaattagaatcatttttaaatttaatttgtccacttacatttagatataattttgctatttcagaaaacattgttggatattttaatttcttaataattttttcttcattaaatggatcaaaaattatatcataaataccaagtgctaaagcataacctaaatattcagagtctttatcacctaataataaaattattcttatttctcttttccttaactcatataaaaaatcctgaaatgatatgtttaaagtagacatatctattaaaggtgagataatgactatatcaacagtgttttctaataaatatttgggatatatactaattaatgaatcttttattttagattgtatctgatcattcaattcatcaataccagtcattatagcaacattcatatctatcactccttagattattatttcattttttagatatatacatattttataaaaaaatttcaaataaaaataaaaactatgtctaaagcaattttttactctaaacatagttttttcttattttgtatatcttctagcccctacgtagtctcctctggtagctaattttgctactttcacgactttatttcgtccaggggcatgaatataatctccaccacctacatacatgccaacgtgacctggcgctgtattagtaccagtacttctaaagaatactaaatcacctggctgtaaagaggacttagagatagatttccctgctctaaattgttcttctgatgttcttggtaatgaaataccacaagtgttataacaatataacattaaaccagaacaatcaaaacaacttggacctgtagcaccccatacataaggtttatttaattgctgcctacaaatactaactactttattacctatagatgatccgccgctattgttagaagaaacaatcatggaacctttatatttgtcagccatatcgaatacacctgttttgtcgggccttcttaaatattcactataagcataagaacggcttgtgccaccattatatgcttgacaacctctccaaatcttttcttcccatcctttaccggcccaatctattctgtcttttttagtatctacatgagaaaattctttgattttttcatatagttcttgcatacctaaatgtatttgagcatctatacttgatagtgcatttcgaggattggagatgtgtaaagctttagcttttctatcccattcagttgtttgcattaatcctacagcacaagtagcttgtaagctataattatttttcacttcagctatagttaaattactccatttaccagaaccatatgcaactgtaacacagttaggattaaatgaactttccctatatataaatccacatattaaccaaggaggcatcttatattcttggcaatatttcatcaataccttcattaattctggaggaatatctataccacctaatgaatcaaatgtaaactgcatggaagaattgccatccaataaccaatccacattctcttcttcatttaatataccttcagataacataaatacttcttctctctctatttccataacggatttacttaaatttttatgtttaaataatttacttaaatatttatcaaatctttcatattcttcacctattaattcattacttgtatttctataatacactaaagtcgattcttcaccgctttctacatttttttctgttaccttttcataggtgtatttgtaatgaccataaggactatctgcttcagttaaaagtatttcattttcttttttagtatcagtaactttaatttttctaccagttaaaataccgtctttatttctttcatctacttcttttacagtagttatagttttttcaaaagttttgtattcaaatttaggtgctagttcttttgcgatatcatctaataattttttattgatttccttatctgtactagaattatagaatactgctatagcataaacatcattccattttaattgtaactcttcatctctttttaaagaatcacttagtttatgaacattcttaccattaactattgtattacttttattgcatttttctactatttgttgacagtatacttttagctctttttgtttaatatcttttgaagattcttcaggaaaagtaaagtagaagaaatctataattgcgcagcaaaatattaagagtaaaataaatggcattaatataattaacaatcttctagcttttttctttatatactttaatatcttttttttcatacggctagactttttcctcagcataatatcatcacctaacctttatagcttttactatcaaaattaggaaagttagttttgtttttatgattattacttttatgtttaagattttgattaccagagttaaaagattgcttgttagatgtaaaagattgtttgttaggtgtaaaagactgctttaccttttcttcagtattactttgattattaatattgttcttattattagtaaaagaatctaaatgtttgttttttttcatactatcatatgcattttcaaatatatttttattaggatcatatcctttttgttctgaataatttgaagaatatgatttatatgcttcagttgctttatttgtaacatctcctatagagtcaattccatcatttataatattttgagtagaatcaactgaacgattaatcatattagcagttgcattaggattactgctatttaatacagcaggtatactagataattttgcaacatttccaacaacgccagtggctcctttagatacttttttagcagctctgataaaaccagtagattgagtagcttgattatctccattgtttgttgccggtttattagtcattgtacttgcaatgctttttgcttgattggaaaatgaagctgcaacacctgctactattccggttgtagctccaacagcacctaatatgccgttagcttttttattttcgtccataccagccattttagttaatgtaccctgcaacatatttcttacaatatcagctaatgttacaattaaaattgcccatattaattgagctgcccaactatgctttgcaacaaagactaaatataatgaaaataacaatgcataagctgattgcataaatatattagataacatttcacctaaccatacttgtgcaccattgatatttttgtctataatccagagtactgcaacaataggtgttagaacataatatactattatagaaaaatatctaataagaaatactatatttatttttatacctaaaaaagagaacataccatacagcgttgcagcagctaaaggactatctacatctaaacttttaattaggtttgctccacctaaagttgcatctaaagttaccttgccattatttaagagattgtagaataaatatgttaattcattattaatatatattaataatcttacaaaaagaggggtagctgctattattatggaagctataagtaatcttacaagactatctttagcttcctgcttgtaatgagcattataagatgctctaaagaattttaaggatatagcaaccgtagctataactattaaaaaacatgcaatggcagttgaatagccaaaccatttatccatattggcccaatctgccttaattatcggagaatatccatcaactgataaacctttattaaacacaatattatctaatgtagagaattctgtttgtgaattaataaaacttgtaaatccacaaataaagctaataattagatttgctattattttttcgaattttccagcaccttctatattgtttatcgcctctttagctttttctttttcttctttagctttttctttatcaggtttagaatctacttttattttttgtggtgttattccatcacctttcattactgcatctgcgtaaacaattcctattttgtgttcttttggtgtcgatatagtatttatataagaaggtgcaataatattaatacatagtatcattagaaaagttaatatcatatttttaaatatttttttacgtttcaactaaatcactctcctattaggtgtttataaattattatttcttttaaaaaaaatagagagtaattttaaaaattaccctcttcttatagatttaattatttttttattatttttagtatgttttttcataaagttagaagcgtgacatattgcaacattaattaagcttaaaactattgcaatagttaaataacatccccaatctatttgaggaatttcaccaatggatactaatttataaatatataatttagtagtaattgtttctattacattagtaaaaaaattcatttttgatgttaatgcaaattcatatataaaaggagaaataatccatatacataaaagagtttgagataaaatataatttttatttttaataaaaccatatagcataaatactgttaatataaaagcaaatctaggcaaataaaatatagataataaatatattagaataaatactcctaacataaaagcactacctttcttttaataattctctatctattatgtattatagttttttatagcttaaacacaataattgtaaaaatattttatatctatatatttatatatacctatctttttgttaaggtttaaaatttgtaccctattataaataaataaaaaactatatttatataacaaaaacaagctatttaaatagcttgttttatccttaaatattaagaagttgttatataagggaattcatatgggataggttctacctgtactgctgtaactgctccttgcatagataaaatacattcaccgttgctaaaagtagttagatattctttagtaccgctagctaatccatagtattgtactatttgttcagctggttgtggattttgtcttaaaagaactgatgtagcacaagatttaattacagctagaccactttcattgtttaagaattcatctatatactgactagcgaataataaagagcatttatgtttccttcctctacgagcaagtacttctaagaagtgagcactttctggatactttacaaacatccacgtttcatcaactgcgattatctttttaacacttttattttgcataacgaatttttgccatagccaagataacaaaacaaatgtagaatagaattttgtaaattcatctgttatatgagataaatcaaatcctattatcttaacatcatctggtaaagtactttcacaatcaaacatacccattgaattacctcttaaatagggaattaatatatttgatagttcttttgcatttggctttttacttaaatttttatggaaatgacttaatgttggcattttcttttttactctgccaacagcataactgccatcaggtaacttagtgccgcctctttgatataatgaattaatatctttattaattccaaagttagcataagtttctattactgctgtttctacagctactagttcaagaccatttaatggccttccagatgtacttcgcataatggaagataataaatcttttatatcacttactttatccattatgggaacaaattctacaccagttttctcattaaaatcaggtgatatgtcaaatagatttattccagatatttcacctgctgtaatagttatataaacaccatccattaaatcgactatgcttttcctatactctccttcaggatctaaaacagctactttagtacctaaagaagagtgtttgtttatgaaactttttataaatacagatttaccgctacctggtataccaaatacacctatattaggattattcaataatggtggtccaatgaattgattaataaatacaggagagccactaaataagtttctacctacataagcaccattaggatgtgttaaatctggattggaaatagggaatagagcagaaacaccatagcttgtcatatttctttcatattcttttatatttggttgacatacaggaattgatttaattaatccttcaatttgacgattagttaacgttctagtttgcattgcttttcctgcaaacatatcttcaatttgtaaggttttttcctggagttcttctaaagatttagcatgtaatactatacttatagtaacaaagaataatttgtctttattagtttgtacattagctctttcttcttctaagtctcttatcatttcctctaatacaggagtattatatatatctccacggttcatgtatacattatactcagacatagcttgaacagatttttttgttaattgttttactactatatcattaggtacagcatcgcaatatacggatagatctatctcacctatattaaataatgcatccaaaaacccaacataaattttcctaggatatacggaaatagcaaatgaacgaatataatgttcatgtcctaaatacatataatccttttcttccattattgcttctggagagaaaaaagaaaatttttcaggaacattattttctatattttcataatagttttcattcatctttatattaaaatttgtatgattcttttttttctttttaaatagcattctttttttcctccttagttccaacgtataatgataagctacctctttgaacagaatttgaaggcttaaatgaagaatttttattcaatataccatgtaataagtcaattatttcgtttgtttccaatacattagtagtgatattttttctttttaaactctcttgaaccattgcacaccttctatttaattcactggaagctttatcaaaaggcccatcatagctaataatgatataattcttcctaacagatatgtttctactattcattaaagtagataaaaaattagaataatgttttgcatatgaaattctatggacattgttttcttttatcatgttttcttgaatctcatttatgttactagatgtatctatattgtgagtagtgctgtaaaattgaacgcagtattgaaattgtaaggctgtatctcttaaaatattttctacaactgtttgttcatcaatagataacaaattgaaatctatagtagatacagataatattacactgtatctattatcttttaatatgatcatattgttttttatatcttctatatcccatatattatttattttgtttatcatttctttatttctggatctatttctgggtatgtgtttatttttattgtctaattcagctttcttttgttgtgatttacttttagtgtcattttttataaacagccaagttcccacaactataactacggataaaagcattaaaacgatacttataataatacctattttcacttataccgactccttattggttattttatcttttatatagtaaacatttattcctttttttaaatttaaggtaatattttaaatacttatcaaagtaaaggccatttatcttaataaaactacaactcattgtaaatgctagaactaataacacaaacaatattttgataaatatatgtatgtgcgtaaaaaaaatcgcaagagaagtagcggcagtagcacagtatcctatttgacgtaaggataaatatccacctaatattttttcctcatgcgagatatcataaggtattttaaattctctcatttttatagctctcccttcattaaaattatggaactcagtatgatgtgtactgaattccataataattaatctacatttgtgctatgttaacaaatacacctgctataataaatgcagaacctaatattaaagcacctatagcaatccataaaatacttcttaatgcctctgaacgagcatttggattatagtgtgtagaaataattctgattgcagataatactatacacaaaaatattagtgcggaacctattggaaaagaaattgcttttatagcttgaacaactctatttccaacctctgaagcttgtgtaccattaacaacggatccaccttgagcaggagcggccaaaactggactacataatatatttgttaataatattgttaaaaatgcgttagtagttattttaccattactaaatttcttcataattttattcatcatagtaccatacctccggacattattaatttaatgaaataatgtagcagaactttgtattatggctaatattagaaaaatgattaatactaaatattgggcaaatacaagagttgttgctttattgttttttataggatttagcattttataaagacctcctataaatacagttaccctctcagcgtttgtgttgcatgatatataagtcccaagattaagggacttgctatataaagaatgaatcctagaatagctccaccaataccacctgcccctacttttcttaagtttttggattgaacaacagttcctattaaaaaaactataatagagataatgaatgctagcattattaaaggtactatcattccaccaaaagcttgtgtgaaagaatctatcgctgaaccacttcgttgaccgaattcagcaggagaaacaggtgatacattagatgcattgggtaactgagtattaacagttaatagagtgttagttaaaatattcatttttatcacctcaattagttattattacgtttttttatttggggcgatatttttaaaaaatatttttaaaatcttctatttttatattgttttttttgaaataacactctattttagataaagcttttccttttatttttcttgtattttcatatccaatattaagccgctttgaaagttctcttaatgtccgcttttttttattaaataaaccaaaataatgtactataatgaataattcagttttatctaaaatctttaatgctgatattatttgacgtgtattaaatcttttctgctctttttccataaacatttcttccgatgatatttcttgctctatgcttgaattgtctaaataagattgatattcatgagtatctattagcctcacattatgttgtgagaaaattttattatatatattgtaattaaatttataattacctttattaagaatatttgctttgaactttttacttaatttaattcttttatttacttccctggaagataatttaatcatattgttattaacgcgaatgctatttaatatataatttcgcatacaatgagtagcgtaagtagataatgcatttcctttattaatatcaaatttttctaaagcttttaaaaatcctaatttagcatcaatcaataaatcgtcaaattccatgccttgtacatttaggattttaaaatatttgttagtccattgaactattagtccctcatatctttttaataattcttctttatatttttcagattctttattgtttttttgcgatcctattattaagtctctctctggtagatctgctaatataatcttctttgatcttttaatttctgagttttgtaccatttatgggtggtattatctcccaagcatgtaataataacaagagagcattttttctcaataaccaatatagttatcccatcatattggataacttttttccacgaattttcttcattaatcatttttttcttagtaattaattgaccatttaatgcaatattaattaagtcttctttaattttagtgatattaactttctcaccatcgcttaatattctactgatataacgatttatagcatgtttcgttactatgatattaagcataaaatgatgtacctccaatcaataaatttgcattgtgcttgcataatatttatatatacaaattaaaaaatttttatttaaaaataaaagggccttcaccatataatgatgaaggctgcttattaagcaattcttttattatttaatttctctcttttaaatatttcaattactttttctatttctgatgttggatccttatcttcaaatcctctaatttgacgaatacaattatcttttacttctatagtgtaaaaagatttatgaggattatctttttttcttaaaaatagaatattagtttccccattagccattttttctttaaaaactcctccaacacaatgatgtaattcttgaccttcttttattaattcatttgcactagaagctacaagaattatataatctttatatttccaattatataacttagaaagttctttatatctttcataaattttcttattatatatctccatcttgtgtttatcaaattcaagacaaatttcatcatgtctttcttttaatttttttggaaataaaataaattcattagataaattatagttcaattgaatacatttatctaaataatctttccatgttattattatgtttgatatgggattatttaatattgtcttttgcttttctagatatttgatagttttatgaactgatgaatatttactaatagcaaaaaaatcatttgaataattgtatcctatattagatacaaatttaaattcttcatttgttattttaattttatttttataagcattctgtaaaatacttaattcttctccagtgatatttaattcttgtgatctagataagtaatttttatctaattttaatatttccataaagtttttacctgataaattaaatagatcttttagcagataatcactattatacaaaatcaaacctatcaaattacttaatcctaatttccacaaatactctataaatggatatttcttataacagtaaagataactatatacaggaaatttaaatccttgtttttgagttgcataaggttttagttgagaatattgatattttgtatttttaagtactttatctaaattgcgagtgtataatgctatattccaaaaatcatattgatgtgcataaagaccagaacgaattcctttgcaccatctattttcatttgtaggtacaaaatttctatattcaaattcttttacagaatacccgtcattaaagtctcttagacattcggatatagataatttggcttctttataattagcaccgtaagtctttacaacttcaaaatatctaattacaagattagaagattgattagctttttgaattaaacaacaaacagtttcatcttgcaaacaaccaactttcccttctgacttaaagattatagaacttttacagcaaggacaaattccttttttattatgtttaggattagttatactaacctcttgcttgcaatgagaacaatatcctttaattgctttagtagttcttttatatttatagaatatatatctactatctattaaagctgtttcatctacccatttataaaaggtttttggtattttgggaatagttttcatataggaattaatatattctaattcagtagagtatcttttaatgcgcttttcatttaatatatcatgttgaaatttataaacatgatataagggtgtatctttaacggttaaatactttaaaatacaattaatagattccgtatttattaacaatgattcttctatccatctataagatataatgttttctattattcctgtacgccattttgtttttttattatcttcaaaacataaagtagcatattctctactttgtttatttaaaaatactctgtattttagctctagactttctcttaaaaagaaagaaagaattaatattttttctttatgagaatttataataatttttgatgatattaaatattttatatcacattctatattatctatataaagatctctttttatattttctattgttacattttttaattctgcttttctcattttcttgttcctcctaattttagtttatagccatataaagttaaaattataaatcaaataaagatacttgtagaggtcctgcttttggagcagggatttgttctacatgttcttctatatcatctatctttatttctacatcatcactatttgcttttgcttttgttttattactagtagaagtatttaaaacatcgataatattgatttgattatttttctttttaagtgtattatcttttccttgtttaattatttctttttttctttcctccattttttttgttctttcttccatagcttttttagcagcagcatggtctatgttataataatcccaaattagttgatgaaattcttctacaggaaggtcccccatttgaccatatttatttctgacttgcgatataatatactgtaccgctccttttaatgtagcattattgctagcgattaaatcagctaattcttcacaaataagctgatttatatgatatacagtagcttcagtaaatataattaccccagccatagtgtatatttgcataggtttcatttcccctatttcttctttaaattcttcatgttctctttttatttttccttcagcattttttaaattttcattcattttaaactcctcctaatttaaagttttagttctcaaaccgtgattttaaatttaaataattattattgcttttttcaaaaataaataaaaaagcaatgctatttatatttttaaaatagcattgcttttaaaagattaagcactaataatagataatgactggtcctttttaacgattaattggaataattgacaattaggtctatcaaaatgtgtaatactttctgcattgtcaatgagcattggcaaatttaaatcagaaataattgataacatgtttctgatttctatacttgttcttattctggtagaattagataacatatttaaatgtttatcttcatagtgtatttcaaaaacatctttaacttctccagaagtcttgctaattttttcaaaaattatttctgttttattaagatgtttttgtatataattactttgtaatttgaccctagctgaaatgaatcttttaataatatctatggttaatttcaatgaagatattctattattagtatcttctttttttctttttaatcttgcaattttatttttattttctgttactaatttttcttttgtacttatttggttgttatattgttgtatttgatttaactctgattctaatttagctaaatcattttttaatttgattattttattttgattttcttgtttaaattttattattttctctttttctgttttctgttttgctaagattttattatttaatattgagatttgatttcttagttgagctaatttattatttttattattttgaaatgctttttctttttttattgtgatttgttgtaagtgacctatctgtctagatatttgtttgccttcattttctttaagttttctatattcatttacttcttgaatatattttttcttttgcttttcgttattattaattgcttcttctaactggtgattagctgttagtccgttatttttaattgtttccaaagagttcaataattcatttagtatttgttcatttgtggataaaaataaaaatccgcatttaggacattgagttttatttttattaatcttattaattttatttcctaattccttatattgattctttaaattaataacattattttgtaaaatatttatattttctaacattggcttttcgataggaacatttttatattcattacgaatatttttatattcgttagttaatttatttagtttctcttgatctgtatcaataaatttttctgcttctgttcttgctacttctatttctaatttctttttttcctttacatcttcatcctcatttatacttatgtcagtatgaagattcctagacaaaatactttctatagcagattttaatttattgatttgtgtttttaatttagtctcatcttttaacttttcagtaggattatcgatacttgataaatcaatactgtctatcattccatctgtatatattaaatctttctccaattcactaatatcatctcttttttctattaaagaaagatttggattattaaaattaaatttttctttagttaatatttcaatttcataatccgaaaattctttcataatttcagatttaggtattttttgcagatatttattgaggaattctctactttttttaggagtaaatgaaaaaaagtagtttggattaattaggcatagaaataaatctttatcacagttaaattctgctaataatttttcagttgtagttttagtaccatctacaaacaaaccattgttattagaatatccacttcttctgattaattcatactccttatcatctatactatagtttatttttactatagtatattttgaagaaagattttttaaatgagatatacttctttctacaccatttaaatcgctatttaaaaatccccatgctattgcatcaccaatagtacttttaccttcttcattttctccaaaaatttgattatctcttttaaattcataaacagcttcttgcttatgtttactaaatcctttcatacttaagcttttaataaacaattccattcttaaactccccctattatatattttgcttagaaaatcttaaaagttttattgctctatttaatattctaggatcacctaaagatttaaaatcatatcccgtagcactagaatattttttaaaatcatctttataaatacaatcctctaataaatcaggatacatatcttgaaggttttctaattctctagcccatttatcataggtgtagtcatctattaaactgtcatttagcctataataagtgcagctatgaactaagacttgtcttcttcttttatttattaattcaattattgcctttttatgagtgtcatttttattgacctgcttttcttcaattatatttttagatgtatgaagcaaatcaaataaattactttgctgaaacatataaaccctccttaaattacatctagcatatatactcatatactaaatttttaaaattttacctttaagccattaatattacttaaataattattatttcaaaaaaataaatatagctaagaaaatcttagctatattacagtaattattgtttcttcaggttctgaacttatttctgaactcgaattacaatatttaaattctactatttctttactgtaattcaattttagttgaaaattaactaaattgtcgttttgggatttagaagtaaatattctacttttaccttctgcaattaattttaagatatctaattctgtaatttctgtattacaaatagatttcttgatattaaataaacatccattcttattactagtgcaaatataattgtttttttctttaattatatattggccacaaaatggacatctacaaataatattctttttaatattttcttctttccttttaatattttcctttatttcttctattaaaatgtttgcaattattaataaaactacaccaataattaattttgtcactgttgttccccctatatattatttttttaaatttttaagtaatatatttattattgcttcacaatctttgtcattattatctaaagcccatgcagtattcattgctactaaggcttttttattatggtttagctgtatatgacaaaatcctttattaaaaaatgccttgctatattttggatctattttagttgcttctgttaaatattttaaagctttaccaaatcttttaagtttcatatagcaaactccaatattatataatggaagttttatatattcagtatcttccatatctttcatatctgatattgaatcttgatatagtttaatagcttctttataattttccttttcaaattccttatgtgctaatttataagcagtatacatgcttcttccccctttaaattttagcttttataagccatatactttatttaattaattattatttcgcaaataaaaaaatgtataattactatattaaaatatagaaactatacattttatatttaaaatttaaatgttactttactatctttttttaaatgttacttcaccatcttttaaaagtattaatttagcattaaaatcatctccatttttcttcttaaaaccttttataacattagtttcacctgcagataataatttcttgatattagaaggagtaatagatttattggcaatggttttccatataacaaatttgcaaccatttttccaattagaacaattgtatcctttactaccttctattatatttccgtcacatagagggcatttgcctaaggcaatattattgaaagaggtggcaaatcctatagtattatccttttttaatattagtttagcactaaatttatctccatttttctttttaaaaccttttataatactagtttcttttttatttaataaatctttaacgttagaagatgtaatagatttcttagcaatagttttccatataacaaatccacaaccatttttccaattggagcagccataaccttttttaccttcaattatagttccaccgcataaagggcatttacctatagatagtctttctattaagattttatcaattataatattattatctaaaatgatatcaccaagatcttttttaacaagatttaatgcataatcaatatttttctcttgcctataaatttgttttaataattggccagtctgcactgttttttcttttgacatatcaatattaagtttatttaatatttcaattaatgttttacctttattagtacatgacaatgaacttttactttccataatatattcatattctttagcattttcaataatattacttctagtagctacggtacctatttctattccttgtaatatagctttatattcatcatcatcattttcatcgatttcttttttcttaaatggatttttaagaaaagtatttaattcagcctcagtgacctttttaggtttttgagtttctttttcagctagagataatttacaatctactatttcattttgattaaagttaggaatttgtttttgtttactttcttccttttcaaatttataaaaaccttcatcttttattacattccctttcaattctatagtatcgctccctatctgaattactactgatgtttcttcaactatagttttttcatttaaaaaattactgataaatctatttttgatagtattatatacaattaattccttctctgttagatcggtatccttaggtatttttatagttggtgttatagctgaatgactttcaatcttagcatcattaaatatttgatttgttattcttaaagatatatctatattttccttttgttttattattgatattatattattaaatttatctttttccttagttgctaagtactctgagtttgtcctagggtatgttacatagcctttttcataaagtccttgtaaaatttttgaagtatcattaagagatattttattctcagtagacattttactttgtaatttatctaatgaaaataattttttaggagattttactacatcttttttggttactttggttactatggctttctctttttttaactgctctaatttaagtaatgccttgtttttctcatctttagaatattttaaatctttaactttagtcttaatttcttttccatttttattaattaaaacatctagttcataatattgctcaggtctaaaatgttctatttctaggtccctatcatatataaactttacaataggtattagtaccctaccaacaggtagttttattccaccagcttttaaggttataaatctagtaagatttattcctaataaccaatctatatatgtcctagccaaaccctccatatatacatttttagttttagaaatatcgtttaaattttttagtccttctcttattgatacctctgtttgctcaggtagccaaagtctttttacttctttttttattttttcttctgaaaaaattctatagataatattatttataattacttcgccttctctatcagcatcaccacaatttattatagtagttacatcgtttcttttaattagtgattttataacgttatattgcttttttataccttcatcattgggtaatttaaacttaaatttttgtggaataaaaggtagttcttctaaattccatctagttcgttctgtattcatatagtcattaatatcatataatcttaacaagtgcccataagcaaaactaactatataattttgattttcaaagtaaccagtatgtttttccatattacctatagctttaactagacttatagctagactaggcttttctgctattattaattgagccatatattacaaccttctttctaaaatcctttactgttatttattatttcattataaaaaaataaagtaagctatatttaattttctaaatatagcttactttatttctttattattaagtaaccattcatatttttttaatcttttttcatttttatatatattttctatttcattttttattttcctaaataagttaggataattattaattaattgtacaaattcatttttaccagattgttcttcacctattaaattaccactaccccttaatttcaaatctttattagctatggtaaaaccatcattagtagtagtcattacttgcaatctttcgctgttttttgaagatattaatatacagtaagattgaaggctgcttcttcctactctgccacggagttgatgtaattgtgccaagccaaaacgttctgcattatttattacaatagtagttgcatttggcacattaatacctacttctatcaccgtagttgctataattatctgtgtttcattatttttaaatttgtttatctccttatctatctgtgtttcattcattttgccagttaccatagaagtttgatatctttgtttttaaaaaaagtgctcatttctttatatatatcttcaattgaatctatgttttccatagactcgcaataagatttttctattaaaggacatacaaaataacattgatgacctttttttatttctttaagcataaaattatatgctttctttttattgtttattaaagcggtttttatcggttttcttccattaggcattgttttaatagttactatttctatattatcaccatacatcgtaagcgctaagcttcttgggataggtgtagcactcattgtaacataatgaatattatttgttttttctagaagaacagcacgttgagaaactccgaatctatgttcttcatcaattacagctactcctaactttttaaattttacatctttttgaattactgaatgagtgccaattataacattgtatactccctctttaattccttgcagtatttcttttttttcactagcttttaatgttccatttaaaaaacaggctttaaatggggtatcacaaagcaatttattaaattcattgaagtgttgttttgcaagaacagaagttggtgccataagtactccttggtaaccattttcgactaaaataattataattaaaaaggcaattacagttttaccagcacctacatcggcagtaagaagtgtatttaccttcttattcttttgcatttgatttagtattgtatcaatagccttattttgatcttgtgttaatttaaaaggtaatttgtctaaaagctttttatattctactaaagttcttattttgatttctgatttttttttactttttctgtttttattttctagttgaaattgatattgaaacaaagtatcaaatataaatcttcttttagctcctattatttgttctttatataggggagcatgtatattgataagtgcttccatttcattttgtaacttaaattgttctagtaaattctcctctaagtattcagaatcatttattaactttagagcactttcaatagagttagttaaatattcatatgacatacctgctatttttgaatatataggcataatttttttgaagttctctgtttccttgcttatatatattggattaataatttgaatttgattattgtatttataatttatacttactgttccacatactatatattttgtatttatagataattttttatttataaatatattgttaaaccatataagacataaaggggcaccaaagtcgtcaatggcatttactttgatgtattgttttattttattgatatttatttttgtaatagttacagctatagaagttgtttgtccatctattaattgatggataaattgttgtttcctaaagtccagatacttacttgggaaaaatcttgctaattcttctatagaattgatatttttctttttaaattgatttacctttttcttaggtatatccaaattgtctaaagatatcatctcctttggacctcctttaaatacctcgtgtgattgtttgtacaccgatttaatttatttattttaaacaatattaaatatttacaaatagataatcactatctagaaaaattaattgcttattatttttcttacaaaagtttattatctttttgtatttattaatattagtttcccctaataataatagatacttacttctttgtaataatatactagctgattgaattggatgaattatatcaacttctctttgaatgttagtatataaatattttgttttagaagaaatagtttcttctatatttctataaggagtaagaataaattttgcgttaaattttttccctgtttggataatagtatcgaataatattacttcataattattattacaagggcatacaaaagtatttaccccatcttcccttataactgttttagttaatgttcttatttgtgaaataacttttgaccaatcaatactttgtcgcttaggatctgctaacattgaaaaagttatattcatatatattcctccttgtttttagctaaatagccatcatataattttaattaattattattacatattggcagcatttaaaaattgtattgtattgtccatattagtgatatctataacagcatataagatattaggacagttaattttaactttagataacatatcagaactttctaaaataactattatattttgtggtagttcaggcatattgtctagaaatattggatttaataatttatttaaataagaacttattatattctcatcacctttaggtatataagtaacatcaaagattttgttattcatgtacatacataagtaaaaagggaaattttccaccatgaaccaattgaacttccctgaaaaatgttttagtaattcaacacaaggtactacatttaagtttctattgaaattaaatatgttagtataaacagtttggccctggaaaaaatcagttttgagtgcatttttagttactaatatatctggtatttgagtatgtttaccttctaaattcattaatttgattatctgatcttttgtagcaaatcctaactggtttacaaaatttcttacttctaattctcttcttaataatccactcattcgtagatcgctcctttcagtgattatgttttattatgaattttttaataatatacaaaatttatgtaaaattaaaataatatataatttaatatacttaaatttgattttatattcattttcactgtgctataataaattataaatacaaaaaatatatttaattctaatgaaaaggtgtttgtgataatgcgacttgaatttattagtaaggttaaaagtaatgatattttaggtaaggatattatttctcaagatggacaagtattgcttaaatcgggcattaggttgacacaaagctacataaaacgattaaagaaattaggtattttttatattcatatagaagatgaaagattggaagatatacaatataattcacaattattagatattaaacaatttattgttcaatctattaataatacagtaaagaatatacataacattaataatattaatttaaaagaatcttttgaaaaaacaaatgatattataggctctattttaaatattaaagaattaatttcaattctttttgatataaagcaatataataattatgtctataatcataacttagatacatctgtaatgtgtatttttataggattatcctatggattaaccaatgaagaattaacatatttatgcattggtagtatattgcatgatattggtaaactggaaatatctaataatatcttaaataaggttacccctcttacaagtaaggagttaaaaaaatttaaaaagcaccctatatatggcaagaaaattgcacaagaacagttgaacttcccagaaccaattattgatataatcgaacagcaccatgaaagaatagacggtaaaggatatccttatggacttaaaggtaattccatttctatatattctaaaatagtttctatatgtagtgcttataattttatgagtaaaaattattactataaagataaatacaaagctaatgatgtctatgaatttatattatcaggatcggatacaatttttgataggaatataattaactgttttaaggatacatttgctatatatccattaggagctgaaattgagctatcaaatggagataaaggatttgtaataagacaaaataaaggattccctgatagacctgtacttagaatttttaatgataataactttagtttttattatgaagtagatttattaaagaatacaaatattactgtgaaaacaataatacaagataggtaagtatatagtacacttacctatctgatgcttatattatattaatgtattaattagaatcctagtaaccctctatcttgattctgatagatttttgcatctatcatatcacagctatggagaaggatgtcttctatagttttcatctgaaataccccatattcaccgttatgagataatatagcatttgttattatctctatatcttcattacttagtttattttctattttatcatttataaacataattttggttataaatgatatattatgggataataatgtatcctttctttttatatatccatcatcatattcatattcataaattttatctatatcatgcatcatagcaataagcattagcctatctttgttgagtttattcattggttgataaaatgggtgcaaaacataattagttactatattatacatatttaagcatactccaaaagtgtgtataaatagtcctcctagtttattttgatgaaatctttcagctgcaggtgctgttaaaaattgattccaggtattattgaaaacataagatgcaaaatcgttgtagggacttttcatttcctttacccattgtttaaattgttttatcatagatttaggtatgttatacctttctatgaaattctctttaggtatgtttgtaggatttatattagtaatgtttatgcttttccttttattaaattcatttatattcccacatatattaactaccatcccttctttaaatatttctcttaacttgtctatatcattaaaagaaacacattctatagggtcattaaagctcaaatccttaatacttattgatagaatttctcctgcttttgtatttttggtctttactctattaataagacctgttatagatacaggttcgttaataatagattcctccataatttctttaataaaacaattttttgccattgtgacaacctccttatttttttagcttaaaaaccattattgtatcttattagattattattacttaaaaagataaatattgattacatataatttattatgtaaattaattaaatgtaaactaaaaaaaagctgaaaaaatttcagctaaatcaaacccagacctatactagaatatcttttttaactgtttgtcttaatttttctatagcattattatacaaatactggatatattgataagaaactttaaattcttttgctatgtctttatattttttctcgtatataatacgagatataattatatttttttctttatctgataaaccagataaagcattttccataacaattttactttctatattattataattgatgtctgttttaccaagaaggtaatcagcactattttcattttcctttccatggacaatagagtctacagaaatggaattattctttaattgaatatgatttttaactaatttaggtaattcatcttctgataagataccattctcatatccttttaattttctatgttgatatgaagaacttatacttaaagatccgtcaacattgaaattaaagaaactacttatttctgcttctatccagtagtaagcataagtggagaatttaacttttttactttcatcaaatttatcaacagcttttaggaatcctaagaatccttgctgggttaaatcttgtagctcaatatttttgtttttatatttatttgctactttaaaaattaaattctcatttttttctattaaagagttcaaatactttttatcttttgttttcttatatttacctacataatatttattaatagaatcaatatcattttcatcataagattctattaataattctttgtcctctttaatttctagtaatttaatataagagaacatatccatttgctctgcttttttatagttttctacaatcttttttattcttggcctttttttcttcttaaatggtgttattatatccaaaatatctttatcttgatttattattgccaaaaacatttaatattcccccttaacattttagcttataagccataaatttttacctatttaattattattactttttataaaattactacttaatgtaaaggaatatcctttagaatctttattaaatattacattattaatttcactattattttcacaaaaatctattaactcaaaaaaaggcatattcttaataagaaacttatttgtatcaactatattttgtgtgaaatcaaaacttgtaaatgcaaatgcagaattatttaataaagcaatagtagtatctttattcaacaatacatgtacatccataagttttaaaatttctattaatatataaggattaaattctttatcagatcttaaataattgtttaactgttgttttaataaacttgattgtttttgcattttatttttaaaatctattatagatagtaattgattatctaaatttacatatctgataaatttatcattgcaaaagcttaatagagagtgtagttctctaatatttatagaactaatgataaaagtgttttcagaattaaattgtaaagctaataataaatctgtaaaaatgtacatgcaaggttttccattaattaattgaactataatttcattgttattattttgtattatataatgtggcacttaatatcacttctttcttttgtaataaattgttatcacaattgttggatagcatacgtaactcattaaacaactcattagctacaatatcatcatctgtatttatgacattttcattgtcaatgaagatagaaaagtcttggtctttattatcataaattaatgctattttcataatctgtatcctccattatgtagttattaataatagatatatacaagattacaaaaaataaaaatgatactaatagactttgttttttaagtctaattagtatcatttcttatatcttacctttacataaattttagagtttgtagtaattatctattaatatcattatcaatgaaacaagccataattatttttgaattgcatattagctaccaattaattaatgcttgtttatctttaatatcataaaacacgcatcttgttttatccttattaggatttattaaatcaaaacaattatcacattcaaaacaaccatcttctataatgaaatcttgaagtagttcattatccatgattgttttatctcggcaagtaggacaaatatattgaaatttttcttttaaaatatttctttctactagctcatctaataaaattttgatttcttcaacttctatatttaaatcacctgctaatctatatttttccctatatgctgtgctattaacaggaatttctagaagtctttcttttaatcttgtttttatatccattatttaactctcctctatactttttaaattgcgtaataaatacatttctggacattatctttgaattgtgatattaaccacatattctaaaataatcatatagtgctctatatttagctatccctttacaagcactccaaggaaatccagtttgcttttttattaattttgctcttttagcaattttcttttgatatatattcatacttacacctctatttaaattttgaattcatcttatcaatattctgtttaatctttgttctttgctctgcaaattcttcgccatgtctaaagcctattctatgaaaaaattcacatgtaatgcaatttgtaattatcaacaagataataaaactagctattaataaattcataaataacctctcctatttgcattatgaattacttggtttcaacaaacacccaaccattattatcctgaaaagctattccatgccccatacttgttgcctgttgtccagttagctcgaactcataattttctatagcttttaatatttcttttctactccaatcagccccaataagtgatatattcccatctctgaaagtatggatataatccttatctggaagcatttttaaaacttcctctttggttaaaacacaccttttactattgtctgtttctgaataaatctcatttacacctttttcaaaatctacacatcttccagtgttatctatactaatcatttctttgttcatattcttcatacaactatcttcaaagtaatgtttacaattactattttcacaatgaattaacatgttatccctcctatatttgaattatggattgcgaacataattctatctataataaatcaacataggtctataacctaacctttttaatctactaatttcaatagcaaaatcgtcaactttcttgtaattatcatggtttatatcttttccgtatatagggaagctatagccacttttctttatttcttcaagtgtgtatttctcacattcattaaaatcacttgtatatcctccgaaacttcttctttctgcattatcttccgtcttacttccccagaataataatgagccacttatacctttatatctattacatacaactacataatttctttccatcatcattccccctttatcaaatctttgaattgtgaactaatatttaatttaagttaccatctaaagctacctgattcccaagatttccatgcactatctctaaaactatcttctatggcatcaaatatatttttatttttcatttcttcgtcattaatttcttttttatccttttctatctccttattgttttccattttaattgtccctccttctcaataatttcatatagcaacataaacaatgtaatctatattgctatatttttaatagaaaaattataaatatccaaatctattattttgattattataattatttaattgctgttgattaatgctgccattataactatttaattgattttgattaaaattcgtatttacattatttgaattattataattcttttcttttttcgctccttttggattccattgatctattttttcaccagtataatcattgttttcctttttctcttttgtaaactctagttgagcttttttcattagtacatagaatgattcttcagctaaaaacactctttttgctgattccaacaatggtattattagttcattttcttgtagcatcatataagatttattgctacatttataagtgccattttgtactatattaagcccttggcttttctgtatatttttttgtcctgttccttcttctattgttatcttccattttgaactacttctcatggcttcttcatagctaataataatctttctaactaacagattattattacctgtatctatgtttttttgaaaggttatgtttgtagattgaacaggatttctactagctattttagagtcaaatcttctaaaatcaatattcttaaatgttccaacaaattgttttactaacaatttgttaggagcagttaaagcagagtaatagcctactctatttttaaatgcagtaatattaccatcacttaataaatgagcaatcaatataatctcttcgggatcaagattatagtatactgctcctcccttgtttttatttcttttgtctattattgtgattctaatgtttggatatttcccgaatatattggagtttatataagaattatcagtaaactgattaggagttaactgatctatgaattctaataccactccatctctacctgttttataaaagcatgcttcccttaattgtttaaacgccatataaatcctccttaaaattttagctttttataagccatatttattatttatgtatttattatttctttttataaaaaacatatggtttactaaaaagcttttattttgtatatatacaaaatagttaatttatataaaatgaaaggagaattttatgttatttaatatgttattattaacaatgatagggagcggtattttaggaacaattttattgataactaagaataaaattataaatttatttagtatggtgcctatattaactatgattattatatattcatcactaacatattcagtggatagagtaaaaatagcgtcgaaaaatactaataaatataaggttgtagaacaaaaagatattgttaatatagataaggataatgaatactacacattaactgatgaaaataatatgcaatgcgatataaagttgaatgaggtcaccattattagtgacaacaaaaagaatagatatttagaaaagagaatatatgaatggaaatatgagcctagaaacttatttgaaaagattaaattaagcgaaatgcaatattatggattaatagaaaatgatactataactaaacaaaaatatgtactaataaaatagaaaataaaaatatatattgttagaaaggtatatacaagatttagtagaagtaatacagatatataatattaaaataaagcacaagaaatgaatatatttcttgtgctttctcattatttatgtcatagctatttttcttcactgttattttcttttgttcttccttctcatatttctcaaaattatataaacatctcatatataaaatatctggttataaaaaaaccaatacagaacatactaaatagaagaattataaataatatcttttttgatatttttattttatttgaaaacatatggtatgtacaaaatgttcccataacaataaaaaaagcagctattaacgaataaatatttaatttaactttttcaattgaatagtagatacttatgatagcagtagctattgcaaaaggataaccataattctttttgacttctttaaattccatatttaacaccaactttctaatatattcatttaacatatatacattttagggaaaataaaaaagcacattatttaaacttagtttaaataatgtgcttttcattgattatttattgttttagtataaaatctagaggtcttaatgttgtaactggctaaacctatactccagattctgcattaggtttttctttttccttttctttaggagcagcatcttcagtagtatttttaatattattttttctttgtagttcttcagcactttttagtttaccatctaattcttcttgcattcttcttaaattttcttctctttgttgtaactcataagttctattttctaattcattctttctattttctatttcaatactgttttgcttaattttttctgtttctgcagctttttcatcttcttgtttttttatattaaataaagcttcgtatttttgcttatcgggtaataattcttgatactttttattaaatcttctttcaaattcttgttttttatctgtagtttttattagtgatatagagtttttagtattttccattagcttattgatatcttctaaagattctaaagagacatattctgctttttcatatgccaataataattttttagcattttcttgcctttcattttcttttctcttttctaattctgctgctttttttctctttatttcctctattctatctaggattggttgagagaataattcacttacgccagtattataattagctatgctaccatctccaggattaatatatttattaactactgtcttaggtctagcaaaatctttgtttggtaaactttcatgtaatttgtccatataatttttccagatttggcccggataagttgctccatataatccacctatactttgaggcgtatctgcccctacccatatggctgttgtgtaataaggagtatagccacagaaccaaccgtccttactaccatctgttgtaccagttttaccagcagcaatatgtctatttaatttaacattctttccagtaccaaatggtttatctaaaacgtcttttaatacatcagttataatataagctatttctttcccataaacttgtttagtattattttcattatggtatatttcatttattcctttatactttactgactttaaacaatcgggatcagtaaatttaccgttattagctaaactagcataggcagaagccatttccactggactagttccataagtaaatccacctacactagctattgggttattatcttctttagctattttcttaaatttcatattatataaatattctaaagctttattaggacctatatcatctaataatttaaaaggtattgtgttaatagaacgtgctaaagcatatcttaaattaacattacccctgtagcttctatctgagttagcaggtccattaggaatagcactatcatttactatactagatatgaagtaaccattttctagtgctggagcataagctaatataggcttaattgcagaaccaggttgtctataagataaaaagcctctattaaatttatcttgaggatttctgccaccaactatagctgtaacttttcctgtactgttatcaatggtaactcctgctccttgtacaacactatcaaaatcagctaatccgctactaacattgttttgtaacaatttttgtgcttttgaatcaatagtagtatatatgttatatcctccactgcgtaccttatggtcgtattcagtataaatttcactaaacttcttttcatattcttttctttctttattgtcattaaatttatatttaaattgaaaatcatctaacttcattaaatatctcacagtattatctattgcaaaggatgtaacgaaatcatcttttataggcttatttttttgtaatttgatgtttattttttcttctaaagcttttctatattcgggctcagtaattttatcattttctagcatagcttttaatataacatttcttctatctatagtatttttataattagttattggattatacaatgatggattattaggaatagctgctaagaaggctgattctgataaagtaagcttattagcaggtttagaaaaatatttattgctagctgtttctatcccataagcaccattagcaaaatagatgttatttagatagtattctaatatctgttttttggagaattttttttctacttctttagatataaatagttcttcaaattttctgttcatagtttgcttgttagttagtaatacatttttaaccaactgttgagtaatggtgcttcctccttgcattgtatgtcctttagattttaagattatcaatacagcgcgggacattccttttatgctatatccattatggttataatagtccttatcttcaattgatataaatgcattttgtacgttattgggtatattggataattcgatatatttatatgaaaatggatttatagaattaattatattattatctttatcatatatattagtagcacctgttctaatgaacgtagtattatctattttagcaattttttctttagcacttttcatggatagaaataaagagtctttatatttaaaataaaaaatgcctccacttaggaatataagtcctaataatatagaaaaaattcttataaatataattcttattttatgttttttaatattcaacttaatcaccttactttaataatttattgattgatcttatagaagtaataatacttattaataatcctataattaacaacataaataaatactgtagctttatgttgctaggaggtaccattgatataaatggtaattccatagatatttttttataaaccattgaatatccatacattgagaaataataagttattaatatgctaattatagtaattaacaaagttttaattaaaaacatattattaataaatatcttagatgctcctaattgatttaatatatctatatcatttttcctattttcaaatataattttatttgtatttgaaaataaaattattattgtacacataaaaattattaagaatacaatatttattttatttataatgttacatattttaattaattgatctattatctcatctagtacttctactttatctataaacttaaattgattctgtaataatttaatgttatttattttgtttatattgtttagttttattacatacattacttttaaagagttgctagatatacctctacttaaattcttactggtggagattaaattgttttgaatatctttttttagttcattcttaccaatttctttatacttagcaacaaattcagcctcattcaaataattttttaataattttttatcttgttttgtataagaattttttaaagttataataacttcagttttattattaatcttatctaataaatgcttagaattaatatagttaaaataaaagactgaaattaaaataaagacacttatacatatgcatgtaatacctaaaaacattttccatttacttttaatttcatctatagctatagataaaaagtaatgtatattacacaaaatatgttcccctttccctatcatagataattgatcctttttctaatttaataactctatgcttaaatttatttactaaaaaatcattatgagttgccataattataggtattttatgctttttatgaatgtcttctaaaatctttattacttcgatactgttatctatatctagattactagtaggctcgtcagctaaaatgagttgaggactttttacaatagctctagctataccaactcgttgctgttctcctccagataactcacaaggcttattatctttgaattcattcatgtttaattcttctaaggcttctatagtttttttgtgtattttatgaagtggatatctttgtactcttaaggctaatgctacattttcatatactgtcatatcattaattagtttataatcttgataaattacaccggtgcttctcttatacattactttctgatgcttagagaatttggtgtctgcaatatttttatcattaacaataatatttccttctgatggaatatctgtattggccaaaagatttatcaaagttgtttttcctgaaccacttttaccaatgacataaacaaatttattattaattttacaattaatatttctcaggatttcaatatctttgatttttttagagacatttgttaattcaatcatttcttataacacatcctttcaatatttcaatttattagatatatattttaaagagtaatcaaaagttggataagattttactgtttctgatagttcaatatcaccaattctatttaaatacatctttgcatttttgtccttatctagatctagtgataataatgtacaattaaaccaatctattttttcttgagaactttgtgccactctttttagaatatctaatgcttcaattttattatttagctgccaaagactcatagctataagcctatttatttcagtattatttgaaatactatagtttttaattatttgatcaaattgtttatttacatataactttgatatattattttccattagaatcacccctataatatttattattttttatatatacgtgtcacgtaaaataattgcaaaaaataataagatgtaagcaaagaatttacttacatcttatatattaattttttattgtttgcacaaattttgttctatttcttttagattctattaattctttaggatattcaaatgttttatatactatttgatctttttatatttgcaattttagtttaaaacaatagacttttatatttatgtataaacttctcattaaaatttaataaattcaatgtttatgtctataataaagtttggttaaaattatatttagcattaaggtagtatttcttttttgtaacatattttcttccaagaacaagaagttcattagtaaattcatatattatgttttgtttattaaatacaattttattaatattaatatcatctttctttacaaaatttatctttttcaaatctggaatagacttacttctttttttgattaaatttgaataattattataaggtgaaaaatatatattaactgtcttgttttgttttgcagtcgcagataatttttgaataatgaaatcattatatattatatcattaagatttgttgtacttagatctatcctagaactagaattacataaaatatttactatactttcatattcattatctaataaagatctaggtttataatataaactttcaatttcattttctattaatattttttcatctgtacttgcaataacatatttacacaataaatcttgtagtttagttttatttagttccagtaattcagtacaatttagatttaaagtcagttcatctttacatctgttcttaaaaatatattttaatttatttttatctaaaatttgattatacattctatcacttatttcagcataatactttttatctgattttataggtataatatctatttcatcaccgttaatacttttataaatatgtacttttattggtaaataggctatagatatatcattaattgattcaatactaattagctcattatttacaaagcctttattataaatattttcagcttgttgcttatataagaacaagttcttaatatctgaaattgaatcttttattaattcaatatttggataaacttcatgttgaagaacattgtctatttttgaatatctataagcaagtttatcaggcttatcttctaatatatgtcctgttaacagattaagataaacatcatcgagtacatcagattcattagttatattttttaattgattaattgcctctctacccttaatacttaaaatggcacttcctgagagaatatttactaagtctttgacactcaagtttcctaatacaaatcctataatttcttcatctaagcccaatatattggaaatgtcgggtactgtattataatctatatttatcaatttcagaatcatttcttcaattaattggagtccagtttctttcctttttataattcctaatgacatttttgctataggaacatatataatagttgtaagaagatattcataacctttattttcttgtaataagtttttggctaaagttgatatagaaaatttcatttatttactcctttactacaatcttcaatatagcatttgcttggatttaatttaatatgatttattatctttggaaacttattatcttcaatatcccaattgttaaagaaacccatatcgccgacaattactaataattgtttggcgcgtgaaaatgctacattaactctttctttctccttttgaaaaccaatcttattatgatgattactgcttttcactgtgctataaattataatatcattttccctgccttgaaaggcatcaactgtattaatagctattttttttgatgaacttttaaagttacagttctgtatttcttttcttattaactctttttgagcactatatccagttataatacctatatctgaatcctttagttttccctctttatctattttttttattaattgtttaataatatcagcttctaggtgatttttatatgatccacctttagttttattttcaaatctttttttgcactttgatgtgtctaaccatactatagagtaccctttatacatgtctaagttatgacatttttcttcttctgagcttccattgcttatctttccatcataaaagacattacttattaatttaccgatattaggatgcattctgtattgagtagataatatttgtttatgagtatctggtaaaatatcatatagtgaacaaaatagccctctctttaaatttttcattgtttctgcgtctaagtcagtatatttatcattattgataaatggaggcagttgattatgatctccaactaaaatagtctttttagctttaattatagaaatcaataactcaggtgtcgttgcttttgcagcttcatcaattatcacataatcaaacaccatatctttaacagcttcatttccagtgaagcctacacaagttccagctataatagtagaatttaaaacaatttggtactctatttcatcagaaccttttattctgtccaaccattctttttgaatattatatacttgtgataaagacaatagttctgaattatctatttgtttagaagttgtagttatttcctctcttccaatattatatatagaaagcttttcatccaagaatttgttacactttttatttatagaatttaataattgctcctttaatgtattaatggtgtaactttggctaatttgggaagaaatatcttttacatcacctattcttagtatttttacattacttaatttactttcaatgccttccaatatattatctaccgctgcatgtgattgtgaaactactaatattttaggcttgagatatgattgtttttcatttttcaatatttgatgaattatttcacttattacagttgtcttacctgttccaggggggccttgtattaaacataaagtttcacaatttaaagctttttttacagcctcttgttgagaagtattcattttggtattgagtaatttgatatttgtaatatgtggctcacaagtaggttcttgaatatctaaaattatatcctttaagttccttgattgataatcttctacctccaatgaagtaattgctctaagctgttttttataagcgtttattttatatctatagtcttctttaattaaatcatgatttgataataataatttaataagttccctttgactattattattcaacttaacttttagtataagttcgttatcattataaaaagctccttcgaaatttcccataggtattggaatatctttatcatgttttttcttttctatcacataaaaggtatcttcagtcaagctatcaatatcattattatcatagcgttctacgaaaaaattaatacttccatctacaatttcataattagtatatttaaaattacctgctttatccttctccctatcaatggagttttttaagtattctttccaatgtttaaaatattgataaaaacattgttctttcctggcatcagagttataatcatctaaatgattttgtaattcaatgactaaagtattattactattgctttttaactgggaagcatcctttataaacttttttgcaccatcaattttaagaaatttctttttaagtttaattatcttgtccaatgatattgatttaatatcatatatatcaaaaatgttgttattataaaaacattttataatataattttctccaaaaaattcataagttccttggttgttttctgtaaaaaaaccataagattcattgaaactagtaggcaaaatagattcaataaattcgttaaaagttgtatttcttctaattagattctgcccttttagctgctggagtttcccactatcaattttaaaataatattttttttcactataatgtatatcatgtataatatctaagataattttctttgcttcatttaaatcagttaatctttcgttacgcttttctttaatcatagaacataatagagatttaaaatctgtccttagaggagatttttctattatgctttcaaaatcactaggttgtggtggtttttcacctgtgaacaaattatataatactgatcctactgaataaatgtcacttaactcagaagcttctcctcttagtgaaacctctggagcacaatatgatttagacatcatttcctttactgttccatcgtcaatagcagattttattttacttattccaaaatcaattattttaacttttagaccatcaaccattatattgctaggcttaatatctctatgaattatattattgttatgagcatttttaactgcatcaataatttcaatggaaattttatatttttctatatctgtatattttgttggaataagcttgtctaaactattaccagaaataagttctaataaaatagcgccgtaacgtttttgcgttttattattaactaatgttgaataatcataaattttaactatattatcatatttatttaatgattttagtgctgtaatttctctattaaaaataatatttttaaaactatcgttaattggacttataagtttaagtgcataatgattatctgaatttttatcctttatttcaagtacaactgtagaaccatctttgtttttatgtatagttctaactttgctatagtttaacatttcatcatcctctctggctaagtttagttaaaacttataattatagtcattaattttaaaatttgctaattaaattataatactaattaatagtcttaacaactttctacaagtatatttgagtctataaacgtcttaatcttagaataaaaacaaaagtgtaaatatatatttcctcattaaaatcacccctataatatttattattttttatatatatgtgtcacgtaaaataattgcaaaaaataataagatgtaagcaaaaaatttacttacatcttatatattaattttttattgtttgcacaaattttgttctatttcttttaattttcttttagcttttattaattctttagtatatctaaatggggcttttacttccatttcagctgatttcaatatttctttttcttcttctataatgttttttgtttgattagctttttcttcaagcttatttaataaattgtctattcttctagtaattcctatttcagaactactagattcaatttcatattgatttttatacttaacctttagtactcttgctaattggttctctgacaataatttcttttgtattcctatttcaaatcctctatattttcctatatatactatatcatcagaaatagaaagattcctaaatttctctattatataagaacctacttctagcctatcttccataatatgattatcattagtataaaatatgaacttgaatttattttctatatcttctgttgaatcatcttctttagttactatagtttccttagttctttgattaatatcctctaatatatttgtatatctattagtaaatgtatttatacgatttttagcatttaatattttatcttgtagcctaaatatattatttttatgttttgcttctaataaactatatttacttacttctgtttgcattttcattctttccattattaaaggattttctgaagctatagctaccattgtctcataatctaacgctccatctcctagatcctccatttctcttatagttgtatcgcccttcatgaattgttctataaaattagcttttctagaaattgtttgccatgcaaatgcatcaaaggttcccttgcaaatatatctatagattctaactttgggatttatattaccttgtctaagcattctaccttcaagttgaactatctccgctggcttccatggaacatctaattcatgagtggcaataattctatcttatagagataggtaagattttgatgttatcgccaccttttccccctcttcacaccggacatgagactttcgtactcatacggcgttccatcaacattaaataattttataattcacaatttccaacttttaatctaagtttattaattttatccaaagcttctttatttagatttaatttccttatatatttttgtattatttcaggtaatgtagcatgaattagtttatgaatatctgacaatataaaaattagattttcatatgcatccgttccaccttgtttccttgatgttttatgatgtgattccatattgcctatttcaagcttctgtcctgtaatagcacattttcctttttgcccaacatataaggagattctattatcattatattgaagtgtttctcctttgattgggttttccaatagatatcgcattatattcatatctacatctttaagatttttatgaattttagctctaccttcaactgtataattacttatatcttgttgaaattgcattgcatttttggttttaataccttctattggaaataacgctatattttttatataagttatcttataattataatctccataatatttcataaaagctttagatttattgccactcttagttttagttgtttttaatctaatatataggctcttcgagactttaaaagctatttcatgaaaatcattgcttacttttgttgctatcttataataattatgcataccaagaatacttgagttatacatattagcattatttgatttagctggacacttctgcaattcttttattttagctttaattttttcttgtattagtctttttgcctttttagaaacatgagattgacatacatattttttacgtttcttttctgctttaagttcaaatcctaaaaattctgttggatgttttcttaaattggttacttttgatttttcaggacttgtttctaaatctaatctttcttttaaccataattttattgctatgaatattttttctgcatctttgggatttttacaaaacactttaaaatcatcagcatatcgcactatatagatttcttttaatttaccatttcttaatgctctatatttatgacttttatctattgttgtagtgccattcttaaacgttctaagtttactgtaattatgttttgtttcaaatgtttcccattgactacttatccaccaatcaagctcatttaatactacatttgctaataacggtgagattataccgccttggggagttccttttactggatttgtaatcatgctaccatctttaatttgtgcctttaacattaaagaaattatttttataagctttttatctttaatgccaagtgtccataattgtttcagaagtttaccatgattaacattatcgaagaaaccctttatatccacatcaaccacataatgcaatttgttcatattaattaaagtcattgctctagctatagcatgttctgtacttctatttggtctgaaaccatagctatgtgggtgaaatttagcttcacatataggctctaatacttgtaaaatacttctttgtatcagcctatcttctattgtgggtattcctaaaggtcttttatctccattatttttagggatataaattctttttacactatggggataaaatttattcaatcttttccttacatattctattatttcatcttcactttctccagcaatatcatttatagttttatgattagttccttttgtatggctcccatcatttttcttgatatttctgtatgctaatagaatattttctttacttgttatagttttgattagatttttgaattgttttccatctttactttgcttatataattcatcaaatatactttgcatgtcataatactcattatttctgagtttctgtttctttttattaaattttctatttttaaacttttcattactcattgttacaatagttagctccctccattgctggatttagccttttttagtcttactcgaacctattatttttgtgattataaattattcaaatattgactagtggctatctctccgctctttattatcagagtttcataggtactatgccaccactttcactgatattaagataagttataactatagtttttccttatcaccacttcattgagtataagccctccatgttatcagcttacaacgttccaatattcctatctgtacatatacttttaggtgcttcctatgagcctgtatgcttactactgcctgtaacagtataaggtctttcataacgcagcaattttactaaacctcacatacaactatttttcaagtagacaaatatttctatttgtcgatgatttagacccgtacattcggaagttcgccagttcctgatggaacattctcaccatgagtattttatagatacccagtctatcatacactcgaccacctctggttcgcatttcgggtaggaatggtttttcatctacttacggtgtactctcaactgtcttcaccgagctttatatctcatgtttcttatatacatgacacatatcggagtattagtagtgcctttcaaggcgttaccctttcattcgacatcttggaatattagttctcctaatgaaaattcattagtgtctagtcttttcaactagaaacgtttcgcacgagcattcatgccttcccccattttactaattgaaccaattaatattcttatatctccttctttaaaagcatttattagcttttgttttttagcaggtgttttagcattatggataattcctatatcttctttaggaatacctaatgtatttaattcttttactatttctgcatataaattaaaatctttattactaggagtaccataattgcaaaatatcagttgagttaatctaagttctttaccattttcccattcttcataaactttttcagcacaagcttttattttattatgggagtcgtcacctgcatttgagaacataagtctataatccaacgctatttttttcccttctgttgtaatttttaacatattatctcttttaggatctacttttgatgtttttattaatttagctctatctgctagatatgatatatattttttaactcttgagcttggagtaacttctactggtataggtttacctgtatctaacataggtcccggtaaattaatcatatctttagttactacatcagatgtaattctaaataatgttgataattcaggaatattattaaattttgcaaatcgttgttcaatttgtaaattttgtcctgtaacatcaacctccaatgagttcactattttgccaaatgtagatgcccattgatcaaagaaatatatgtcgtgctcttttaaaatctgaggctgaagatatctttgcatagtatatacttctaccatgctattactaacaggtgttccagtagcaaatacaacacccttaccttctcctttaatttcatatagatattgaattttctgcagtaggtttgttgctctttgtgcatctcctacctgaattccttttatattccccattttagttttgaaaaataagtttttatagttatgtgcttcatctaaaaacaatgaatccacacctagctgttcaaaattaatgaattgctctgtattagaagaagatagtttttttaatctggcttctaaattttctttaattttttctaattttcttgtacttactctgtcttcttctgaatccatttcttttataaaatcttctatttctgaaatttcatcataaatatatttttcttgcttttctattgatacggagattctatcaaaagaactgtgacctattattatagcatcccaatcaaacagggcgattttactaattaattttttcctattttgtttagtaaaatcttttggacttgcagataatactttagcatgaggatataataaatgaaactctcttgcaaattgtccagattctacaagatgattaggtattgcaaataaaggtttatttattgttcccatctgttttaatttcatagctgctgctgtcattataaatgttttaccggcacctacacagtgcgctaataatgatgaattaccgtttaaacatctagcaatagctcttaattgattgggcctaaattttatattagggtttttatatggaaatactagatgatctccattataccttctaggaacaacagaattgaatatttcattatattgttcttctaatattgttcttctttttaagtctttaaaaatccaattattaaattcaatttgtatttcttctaatttttgtatggagagcatactttccttagcattcaatactctttttttcttatctgtatccggatctattatagtatcataaacattaggaacttttaaattaagtcctgctataatgactgctatagcatcctttctttctgtaccatatttataattcaatatgttgtaaggacaaccacatacagatatttcccaagatgcatcaatcttattatattctacatcaacatccttagcttctaatatatatgatataaaatctttgtaaatatccttaggtacccatgttgctccaaagtttactgtaatatcttctgcagttattggagcgggctgaactttttctaaggcttgaacatttacctgaaatttttgattaaatttatattcttgttttgctaaatttagtttttttcttacattaccacttaaataatcatcttctgtttcccattgttcagtagctggattaaagaagattagtttaccatttaagtagtctataacctctttttctgatttacttactaagctagctattctgctaaaatctaacttacctttctcacctaaagtaatataataagcttcttctatactatcagcttttgttactactttaggtaactgaattgttcttttagtaaatatatctcctttagaaatcttatcattttccacaatctctatggagcttataagattataataagaatctttattataagctctactattagcagtactgttaatatatccatatgacaaaacaaatttatcatatattgtattgagctttaactgttcttcttttaaaacatcatctgaacagtcgtctaattgtatattaataatatgttgaacttgatttttaagtgcaatcatattggtgattcttttaaatgttatactagaactagatagcttttgttcaattaatattcggttgttattttgatatagtttattatttagtacaacatattcatcttcaataatactatcatctgcccatataacatctttttcttctacatctatttctttatatatctcttgcggaatatattctaatatttcatttaatttttcttctaaattaccatttagttcaacggtatatgttttgccaaatggttctgatatttctttaatatttcctgctatcattttaggattgttagaaaaatactcattaatttcattattaacttgcaaccattttgatagattactttcattatgattttctaacttcttttgtaatattaatatatctgaaactacagtagtattagtattaccaaaagcaatattaggcaatttgatagcagctatcaaattagccttttcccctattatttctcttaccttattagttttactacccattgtaaagctactagtaattaatgcaactatccctcctggtcttactttatctaaagattttacaataaaataattgtgaatgctaagagcatatttattataatttttatcatgtactttgatatttccaaagggcacattgccaacaactacgtcaaaataattatctaaaattctagcattttcaaaaccagtattttgtatttctgcattttgatataattgtgctgcaatggaagctgctaaaccttctttttctattcctataatattagaattactttttatatcttgtggcatatagcctataaaattcccgatgccacagctaggttctaatactcttccatgcttaaatcccatcttttttaatgcattatgcataaaagaaattatgctcttattagtataaaaagatgtgttgatagaagaaagagcatttctatattcttcttccgttagtagttcttctattttctctctttcttttatatatttattttgttgaaaaagatcttgtaatcctccccaaccactgtattgagaaattaaatctttttcaaacatgtctgcttttctcacttgctgttttagttttttagctagttttatagctataatattatttttgattcttgttaaaattgaattattttcaatttgctttaactcaaatttttcatcttttaatttattatttttagttatatcaggattcaaattaaaaaaatcaatttgagctactttagattgagatttttctttagtaagtttcttcttttttgatttttctttagttttatgtaatatctcctttcctttgtctaaaaagtcaaatagtgattgtgtaataaatgacattttaaattcctccttaaattttagcccaagccacaggccatagaataattaattaataagttattattgcaaaaataaaaagtaggaatactttaaaatattcctacttattacttataaaaccctactttttatatatttttttctccagcttttataaaaattctttggatcttttatattatatctttttaattctttaatacaatctcctggatccattctatttgcattttctaatacattttttatagataagtatacattagatttttcttctcttttacatattccaaaatagttaactaatttactttttacagaactgatgcttttatttaaggcaatagccatttctttatatgtcattttattgtagttatgtgaaccaccaccacttatagaagatggtggcttcgtggtcaatatatctaacgatacaagtttacccacgctatgaaggttattccaacctttctagtcaatatatcttttattatattgctaggtttaataagtttttactcgcatttaagtccctgtccattatcattccacatacaggacaaatataagttctacaagacaaatctttagtttgatttgatttattaccacaattagaacataattggctacttgcataatttgatggtgcaattatcaattctctaccataccatttacatttatattctaacatcgttctaaattcgtaccaactaacttctgatatagcttttgctaatctatgattttttaacatattactaactttaaggttctcaataactattgcttgattctcgctaataatttgcattgagagcttatgcaaaaaatcttttctttgattagttattttttcatgcaatcttgctatttttaatctagctttcttcctattattactgttttttttctttcttgacaggtctttttgtaattttgcaagtcttttttctgactttcttaaccatttaggattaccaaaaaaatcgccatcacttgtagttgcaaactctttgagaccaacatcaataccaacttttttatttgttttaggtaattggttattttcagcatcaactaatatagaaatataatatttattacttggtgtttttgatacagtgcatgactttataattccgtcaaattttctatgaagttttattttaatcatagtttttaatttcggtattttaattctgctattttcaatatatatagtacctttttgattatttgttgtataactatgataattactcttcttacttttgaatttaggaaatccaatagatttatctctaaaaaaatttttataagccttatctaaatttaattgagcattggctaacgctaaactatcaatttcttttagccactcaaactcctttttatattgtgcaggtgtaggatacttactttgcttaatatctaaatctttgttttctttgtaagacttgatcctgtccgttaacatcttattatatataaatctagtgcatccaaaagtttttgcaaaatatagcttttgttctttatttggataaatcctatatttatatgcttttaacattcacttccctccttaattttctatatgttccttttatttactaaagtcgagggctattcatctcccacctaagaggatgggagaattacgctcgttaagttcacccccctctcttttattgttttttatcaatattttagtcatatttgattctcccccttaaactttagcaataagccataatttattaatataattaattattattgcaaataaaaaaacatagtatattttttaatatactatgctaaaacaattttattaagtttctagcaggaaaatcacatacaaagttaatttctcttttcaagttctgatattaagtactcaagttctgtaatatttaacatttctcctattacattagctaatatttctgcatacttatcctctaaagctttcatattttttggtaaaattaaagttacctcatccataattaccctcctaatttttaaaattataaattatataatcctaaatttttattacactcatgcataatacacataaatagtatattcacaagagttttatcttcttttgattttgtaaagctaataattttgttatgaaaatacattaaaccttcaacatcctttttaataatgtttgattctattttattataaatttttatatatgtatcttctttttttatattattacatattcctagaatattttctaaatatccatatgctttaatattattttggaaatctttaatactatcaatagtacctggtaataatgctaatttagcaatactttcgatagatacttcatctctttcttttttattttttcttcttaatgttttagccatgtttattttccctccttaagttttagcaataagccataatttattatataattaattattattgcaaataaaaaacatagcatattaaaaatatactatgttaaaagatcttattaacattgcattaatccctttctactgttttttattatcccttatatataagaagaaacaaattatagaaggcataaatttaagagcaagtgatacaactattagtgctgcaccaataatataatgagtatggttcctagacataagccctagtaacatattgataattccaagtataccgactaaccgtgtaatagatatataatgcattatatacttcctccttttaattaataatttaaatctgtctcgtatatttgtgtgtcatcctatccatcaggacatagaaaatgatataacatttatatatctgattgcatgtacctgcaaatttgaatccatctggaaattcttgaagccctgcatattattttgaagtttattactatcttgcaccattattggacttttctcaaaattagcaactcaattattttagaatagtattctttaaagactaagaattaatagatatattactctaataactctgaacattaaatcttatttatctacttgcattactcatctataatccttattacttaaattaaaatatttttgaattgcgacactatttatttatctttacttaaaataatcataccttcttgaatagattttacataaacaggtggattttcattaatcttttgtccttcttttaaatctatcccatttaatttatctataaattctttattatctactggtacgattcctgatataataggatgttcaaaaaatattccatattcctatagttcctcctaattatttaaacatttttctttctaaaaacatctaaatatttttctcctaatctatctatttcttttttatatttagttccttctgctaatgccccacataaattcattaattttgcttctgcttcctgaagtttaaaatcatctaattccgtttcaacttctgcacaagccattaatactgttttagtcttatctttcttcatgttaaacctcctcatgttttactttaatttcattcatagatctaatgtttgaattgcgaacatattatgtctaattcattcttacaatatttacaaacagtagtataatcattttcattataatttttttaaatattaaatacccaatttatatatcgtaatataaatttccccattgtaataaaaaaccagctaaaactattccaatagctatacgctttaattagtatcacttaaatagtatagtaataaattttgatgctattacaatgccaaatgcacctaaagttatcccaagaaaatcaagcaacaattcctgcttccaattccaattactttctttttccactaatacaacaaaaaaaattacaattaaaaatgtaactatcattaacactttatttttgcttaacatattatacctccaaattacacttctttttatataacctaatacgtaaaatagacatttatttcgctccttcgtatgaatttcatttatgaatcttatatttgttatttatacttctagtaataaaattaagctataccaatatttaaacattgtagacatataaacaaggcatccggctatttacttttaggtgaagtgtatttgatatgccttcataaatatcaagaatatgcaagcacataatagtgtccttgatatttatgagcatatcaaatagtaagttattaatggtaagttgaccaaatgcaatcataacagctccattttcccttacatatctttccccctccaattacgatgaaactgaaattattaagttctaaatatataagacgtcagaattccatttttattcttgatactaagtttagctacccatttgcaccaactccaagagaattcagttttcttttttactaattttgctcttttagcaattcccttttgatatttattcaaataactccctccaatctttgaagtgctaactataaacaactgtaattaatttctttttgacgtgtatttctgctttcataattaggacagttaaaattacacatagaattgcactttctacattctgcttctacacaaccaaaatttatacatatattattttcatcaatatcaaacatataaaatcctccctcctataaatttcaatcctggatataatcctcaacttcagtattttttatagtttttccaaacataattgaatttctttctaatttatagtaattttaattcctataactttttttgtattgtaatatactagccagatatctttaaagtattttttattttgcatttcaagaattcaaatttactccaaaatatataataattagtatctgcgaagtcagtatatgaatacacataagagtataaatattcctgctcttttaatatagaaatcagcttgtcttcaataaaatcattagtgaatctcacctcgtcatatttattgatgttgaagccttcacatagttttttcacttgttcatacatttcaaaaaacatacgttcataaccttttaccatttcctgcttgattttcttttcaatactttcaagaaaaatatatttattgtcattgaatattttgtttgctataggtattaatttatttttaaaataaaattcttcatcttttttaattatttcagcttctttctttaatgttgcaatatttttcacaatcgccctccttttttattaattaattaggttataataattacaatttttttcagctatttaataatgataaatattctcctattgacataggatttgcttttataaattgtttcaatttgtccaattcttcttctttgataacatagtataatttaccgcaatgctcaaatgtacataaaggactaatttttgaattatgcaatccagtattttttaaatagtaacagctccaatccagatctttcttattaactattttacaaccatttctacacaacactacatatcctttaggtaaacttaactcttttaaaggaatattacgttttattgctaattgataattcccattattaaattcagttattgcttttttatcttttttaatttttatattttcatatatttgttcataaatatttgacagtataaaggttactgaaccactaagaattatataaaattctagatttagatgcttaaaatatgatacataaaataaaaagatcaatgaaacaatgcagtcaaaatagtattcctcaaagaatataaataagtttacaaagattaaagcaattattatccagatatataagtttgatgaaaataataccaatccatttattactataattaaaaccaatgaaataataacttctgtactggaaaccatataattcaccttcttttgttattaatagtcactatattctacattttataaagcaatacatagcctggatctttttttataagggaaattattttataattacatgggttaatatctttttctataaataaaaatgatctattcgatacatattatttacctccacttcgattaagttatgatattttcatttttggatttgctttatttgtattatgtattttctaatttttctataattttttttataacttctgcggggtacatttcacataaaattctagcatatgcttgacatgctcttctttctatttcctctatctttacatctttagggaactttataattacattttttatttctgcaccttttgccacaagcgataccacctttctataaattttatagataaaagttctgtttctatccatattctcaatataatttaaagaattaataaatacaataatactatggctctatttatattagacatatagcaatatttttcaaaataaaaaacacgatatattattttaatataccgtgttaaaaaaaattattattgattataatgaaattttcaaattattattttattcttttgcttatttcatttaaatcattatatatgtcccttagttcgctaagttcatcatttattatattatcttctatataataaggttgtatagttacaaaaccattcctcatgatatatttgtataatgagaatttctcagttttaaaatcataaaaccgactttctattttgccatcttttattatgtaattatctaatctcaaagaattgaatatatcttttttatatctatcagtattgatagaaactgaaaatatatgttcattttcatatatttcattcatcataagagtagtatgaccacacatagaaaacaaaaccaagttatctatatttccaaagtcttgtacatttattaaaccatattcatcattcaataaatatgaaaagaattcttcccttgatgttccataattaataactattactccaatattaatgtctttatcgttacgtgtttcaaatttcttctttatatttcttatgtttctatttgtttgcctgtagctactgcttatttcaacaattccatttgtcttataatcaataaaatcttctaagttactattagggaaataagctttccctaatatatcaccatctttaagatttatatcttttagtattttagcatcttttgaaaaaggatcacaatctaatgtttttacttcaaaatttaatttagttttatcttttaaaacaaatgtgtattcatatttcttattatttgaaccatttggctcatagtctagatgatctataattttatataattcactcttaaaataaattccacaaaagatgtaaaaaaatactgaaaattcacttaaattttcattcaaacttttataattgaaaacacctttattcatagattttaattttttatttatgtaatcatccatcatctctgtattatttaaatatttcttgcaaataaactttgaataagaaaacgaaaacaggaatttatcagttacaaatttttttgttttaaatatatgatttatcggataagtcttatctattatattcaatatctcttgtgcattcactaagatttcattatagcattcttctattgaaatcttaaatcttagaaatagaataggttcttgccttagtgttgtatatatcataatttgtagcaaatcaactctacttatatcatttaattcttcattcataaatatttctcttcccttttgtttattttgctatagacattaaaataaaatccctaataatacttttaaatattatatttattttactttcttcaatgtaactacaaaaaattaacttacatatccattataatctttataatgatttttttcaatttatactatattattcattatatggattacatcttttaatttattgtaaatttcattaattaaaaaacagaaacaaaagtgtatatacatatttttaatgtatatacacttttataaaaaacatattgtattttaactatttaaaattaatccaaattatataatcctaaatctttatttgcttgatgcataatacacatgaataatgtatttgcaatagcagcttcttcttcagattttgtatagcccataagttcttgatgtaaacttatgagatattttaaattatttttagatataatattcttcattgtatcaagtacttctttatatgcagaattctttattgaatgaaagaaaccaaacatattttctaaatatccatatgccttgatattatcttgaaattttttaacgctatcaatagtatttggtaaaaatactagttcaacaatactatcaatattcttttcttttaattccatattcattacaatctccaccttaaattttagctattattagccatataattttatacataatctatatactcttattttctcatatgattcctaatccatttttctatatcatctttattaaattcatctttggctatactaagacctaattttattagttctttttgagtatagcgaatatcaatattattaagctgacataacaaacagagtagggatatccccaatctcttattaccatctagcatacaatgattgttgatcactgaatagcttaagacagcaattttttctatatcatctttgtataaatccattccagcaaaagtttgaaatggattttctaaggcacttttaagaagttctttgtctcttactccatgacttcctcctgttctattgacaattttcctatgaagtgttaaaacttcatccattgaaaatactagcattttgctaattcctccaatgcttttagattgtcttcgagaaaacaatccattaacttttctttatttttatgtcctttattttgtttgttttgtaatgcaactttgagcaaactcctgcgatttttcaccgtatttgtattttcataattctttaataatctcattctagttcccccttaaattttagttaagttatattaaccatgggatattatctaattaattattattgcaaataaaaaacatagtatattaaaaaacatactatgttgaaaaacttactattagttgtaagtattatatttttactatttaattttgtagtttttagatatctagggtcttattttaatttttttatatttagctactgcttttattgaatttataacaaagtattataaaataaaaaacacagtatattttttaaatatactgtgttaagaaaatttattattttatcttaacttatactgaattggaactatgaaagtatatatttccttttttatacctctacctttatattctgtttttattttaaccattggctgctctatatcctttttaataatagtatattcaacttctggcttacaataaagaacagattgtctatgtgtaaattctctaactttttctattttaccatccataaaaaaactcacataaatttcgctactattttgttctgtaacagtttctatttttacatcttctatttttttattaacttctactatttttgaattgctacaacctgtaaaaagcaataaggttatcaaaatcacaaaaaattttttcatattatatctcctaacgattattttttatttaattctcatcattttcaaaactctcgtaattcttttgagaatactatggtttttattactccatttttataaacagttataactatcctccattaaactttttaaaattctaatattatattcttctttcaaatctcctaactctttttggagatcttgcacatcgtttttaagcttgtttatgtttatataatctctattacagttcgctatatctaaacccatttctagatcagctatgtccatataaattgcttctattttgctagataatttcatatctagatcaaatattttataactaacctcctggattagttttttttctaataaactttttaaatccactgtgcgagaaaaaaagacattctgaaaatctcttgtattagagaaaaaattaatctctccatctttataaattaagtaatctcctgtttgagggtgtggtacaccaagggtagattgataagttcctaagcctggcatttcatcatacattaactctgaaatatatggttccagatcttgatctaagtcttttactattttaaagtaatgattattcccatcatttaatttttcaaatttgtttttcatttctaattcccccttaaattttagctattattggccatatattctatttgattaattattatttcaaaacaaaaaacatagtattaaaaacatactatgttaaaaaatttaatattaattgtaagttgtttcttagacctgttttatttgtatagtcaactactcttctaagtatttatttcctatctcacattcatcaatgttaggctttatagtcttacatatttcatataaagcacttaaataatcacttctatcattgaaatatatagcattatttgctattgcaaaagccttatcaaacctttctgaaatcgtcactcgctctacttctactatgtgcataccatatcgtattgaactttctagtaatctatcatcttgtttacttaaccactcttcggcttcacttttatctgtaaaacttgtaaaaatccctttttcttctttatccataatgtcataatatttcacattaattcacctcattttacttcataataatttcaattatggaactaatctttgaattacgaagtaaaattacattctgtcaaaatcaaaattattttcattacacagtttttctaattgctctatatccactatatcataatcacttattgaataagtatcaccaattggatgactatcatgtttatcatgatagtgaatataaaatatcccttcttcttctaataatagtaattcaactttatctactccatatttattaatggcattattcatttctgtaactatctcagttataaacttatacggtttcgcttcttcaattttactcatatttaaaacaccttttcttttgcaataattcgcatttatttaaaattacttactatatttttggattacgaactaattccattgagacatttaaccacttgtgtataatagaactataatcaaagcattaatatttatcccattctaataggtgcaatcttttatcgttattaatatattctgttgctttctcctttgaaccaaactctaaatatttaaaaaataaaccgtctattatacttcctattaaaagaaattctccatctttttcagcttcaatattccatttcattcgcttgttaaatattggtcttgctaataatttgtttttttctatataattttcacattggttcaattgatgccttaaaaccttatgctttttacagaatataaacttagtaatatttgagctaccgtcactgtatttacattttttacaaaagccctttaacattctttggtctcctccgtttaatacgcatttttttcaatttgtaaattaaacattatgatagatttttataaattctccttttcttgtgaatttataagtagtattgcatacatgaatatatttgtattggccacaatcaccccaactatattcttgatgattacaattaaacatatttatcatatatttataatccattctatttatatacctcctggtacgtcatattaatttcatctaaaaatatatcttcttatttttcccaagtggaaatcttctatagtaacatttcccttttttttcttcccgctgaatactcttaaaaagatttttaagttcttctaatttatcttcataacaatcttttctaaagtaatctttattatttactctaaactcaactctatatttatttattttatatccctccatatttgtattacgaattatccttcttcttgacttttatcacaattttctacagatagttctgattttgttaaatcatatattctgtcaagtaaatccattgaaaaatcaaatatttggctataagtactatagcttatcttacccacagaattaagaccatttaggaaatctgccatttctgactttattttttctttaggggtagctgtttctgagattccccaatttcccatgtaattcactcctccacattaattttaagttcaattattgcatattttacaacagctgtttaaatgtcgtatcaatagccatatttatttttacgccattcacttgcttcttctgcacaatcttcatcattttcggaattacatacaccatcgtgataaacttcatcattatctatatccttttttgatataactttatggcaccaaggacattccacctcatctttatccgtatcaattaatttccctgataaatttttatatttcatctttatacaacttccttcctatttttttagcttacataagccatatattctatttgattaattattatttcaaaataaaaaaataagcatctgatagtctattaaaaccatcaaatacttatttttaaaacatatatttaattttcttatattattatttaccaagttcttttaatgcttcttcattattatctataaaatcatccattaatttttctttatcttttttttctttatatttaataaactctatatattctattacttgcatctgctgctgctgtgatagacctttaacattttgaaatatcttttctgctaatagcataacgatcccttctctcttattgctgttatttatatatatattactatcatcactaatttttgtaaaggagtagttaatattcatttaattccaaatacacaaatcatgaaagtattttatatctatatatttatatgcctatcttttgttaggattttaaatttataccctattaatacaataaatagaatcccatatatacaagttcattctccctattcttctgaccattctttttttacttcttttatatattcttctctaaacttaatatcttttaaaccatgttccatattaagaagagtcagtacttcatgttctgccctaaactgttttttagattcttctcttaattcttcatctaattcataaacagattctaaagcaagaattgacatataaagacgattgctaaactcaaagaaccagtaatttggtaagtcaaatttaagagaatcaaactttcttagtaactgtttatataaagtatcatttttagatattccttttaatataagtatatactctgattttatatcagatattatttgttctgctttcaaatagtttttctcgaaatatttacttttctttttcaatcttgcacttttaaaatccatggtatccattattattctccttataaatagattatatatttctatatcataaatattctatacttatatgtatttgaccttttcagatttattataaaatatgaaaaacctgctaatataccagcaggtccttctataaatacaaattagaatcctatattataatgagtttcagcacccttaaatccgatatcattagttaatttttcattatggtgcaaattagtagcattgaacccattaacaggtaccttaatttcagctttacatggtatctgtactaattttcttattgtttgctttgtacctctctcttcatctaaagtataagttctagaaacataggcttcagcaataaagttaatagttaggagcggattatcaccggcataatcaaatttaaatatacatgttcctccattttggtctagtttgcaataatatggagaagtataatgtgttccatgaccaccaaacctatccaagctatgatttactgaccatttttttatagtggctcttactccatcaatatacacaggacttaaagatatattcatagtatactctgtttctttacctttttcgtccaaatgatatctggtgaatgggaatttagcatcagtatttattatcatatgtgctgatccgccactgcttcccccactaccattgctacccatgttaggggtaaatcctgttgttttatattcccatctataacgctttacttgtctttctttttgaacacgtcttgttttttttgttgttgtttttatttttaccaaaacagcatattgtaaatattcatgcggacctccggaggaatcaggagcaggagagtgatttactgttttttcttgtacaatattataaccagcaaattgatttccaacttgttctcgtgctgaatccgtaaaacttttattgggatttataggaactgctataacatcactatagagccatttaacagtataatcttctacagtatagttctcagtagtccaatatttctcagtagtccaataacctactctttccatatggcttgtatctatataaggcggttgtttattactatttttataatcataaacacttgcagcagatacaagacttgattgaattattaatatgataaaggatagtataatgcttaataatctatttcctttcatattttcacttccttacatagttttatataattattatttcaaaaaaataaaaacaactattttggcttttaatagttgtttttattttaatattttatttaactatacaatatttaaatatatcataagaagatgaattatcattagaaaatgttatcataactaacatattttttgggaaatcagcaggataaaaattagcattagattcttttccatgttccattcttatatcactcatatctataacacaagaattaaaacaattataatatttaccattatctaattttaagccattgtcatcagcaaatataacttttgcatataatgcagattttgtttttcctgcaacggtaatctttgtagaaaaaggcttttggtaatcaattaaagtatatgcattatcagatgttctcattaaaatagcatttttaactaatttatccgtccatacacgatttggatcattgtaattattagtttgaatgccttctctaccaagtgatttatcaaagaaatctaatctttttcctcccatccaaggcgctccattgccatatgggttaccagtaaaatcacccttccaaatagtcacttccttaccattgatgttttgtatttcttttttatatccactggttaactttttctgctcctcaggcatatatttaggattaagagaaggatcttttatatattgcactttttgattaataacttgtacataaggtttaatttgacttgtatacttatctaagtccatttttcccattatatcaaaatttaatttacgtgaactaatactatttccaataccaagtaatattacaactaaaataagtccttttaattttttcttaaccatatgtcactcctttccatcctaaaatctgatatattttaaaataacactgctattttttgaatatcttttattttatcattttctttagatattttaactaaagtatttttaggataatactttgctgaataatctgttgcaccttcatacaactctactggactttcaaatgataaactaatattatcttttttaatattaaagtattgaccattatctaatttgataccattctcatccgctgatacaactttagcataagtcatgcttagtttaacatttggatctatttcattatttgtaatagtaaacggctttttataatctataaaaatatatttatatttatcgcccattttttgtttaaatgcatacacatccttaaaaaccttttgatttttagctgttaggaattgcacatttaggtccatgttttctttgctacttatagtttctttacctggagaaattattgtttcagttacaaacccttctttatgggctacttctaatattttttcattattaacatgaattactgttttatctttagtataatcaaccttagcatttcctttataaacagttatatcacttttatatattttttgtatttctttgctaggcttttcattctctttattctcctctactttttcttgtgtattttgaacagcttttgtatccttggatttattaagacccaccgctattccacctactataactacacaagcaataattattgctgttatcttctttttattcatataaactacctccaaattatgtctctatctatatattatttctatttttagcaatctttatatttatatattaaattaaaagcattatttatacaacaaaaaaacaaatatccattatagatatttgcttttttactaatttaatttttatcatgaataaatatactttatataagcaaattatgttgtttacatatctctttagataaagtttttattccggttttaaataaaacaatgatattatcacctttaatttcttggattttaccttctccaaactttttatgatatatgtttttgcttattatatcattgcttttatcattattatctttattcttatttattttttgtaattcatatataaaaacagaaggatctttttcattatataggatatataaattagctttagctctagtacatcctacatataatagtcttcttgttgattcaatcatttcatttactgcttctgtaggtattttctcctctttttgtttattaaaagtatcaaaaatgttattattaatatctgtaataataacatttgaccattctaggccctttgatgaatgtattgtatttaaagtaatgtttgcatcttcatcattttcttgaagaataacattatctatctcctttattctaataatgaattcatttattgtattagtagttttagctatatatttaatgatatcaactatctgagaatcagattttttatcattatttaaatactctttatattctaaaatattaaatataaagcttataattttagcaggattagtatgctttgcgagttgctcaaaatcaaaacaaatatcattaattttttctaacatatattccggtatgtctaaactagaatggtatcttctcatatagtcaaaaatgttaagatcattactaaattcattgtattgtttacatactttatttagcattgatttacttatatatataggctttattttataaactatctgcaaatataattcagcattgttcatattttgactaaaataatagattcttaatatgtcttttataattttatttgttgataaagaaggaaatttagcttttatattgatatggatattatgattaatacaataattaatcataggtattgcagacatattatttctatataagatccctatattgccatttaaatttggaattaatttttcaaatattgttttattggagctctcaaaatctgtaaagcttcgtaattctatacttccttctgcatcgttagaggcaatcatttttttattgaatctttctttatttttattaataaatatctcattgtatttgactaaatttttataacttctaaaatttttgtccatatatattacttgagtatttttatattgtttaggcaaatttaacaataacttagggtcacttccttgaaactcatagatagtttggtcatcatctccgaaaaatgctaaattatatttgtccttatttaatttttcaattattttgtattgtaacgggctacaatcttgagcttcatctatttgcatgtattcaaatttattaacatatattgattgaatttctttatttgcggctaatagattattagctatgattaacatatcatcaaaatctatataattatatgttttttgagttttataataattgttatatatatcaatgaaatctgtaggtaaatcaaatagttctattttagttttagatttttccattacttgctgtgggtatataaaattgtttttacacaatgatatcttattagaatatagttctagttcatcttctgaaatttgttctttattatgttcaaaatagattttagaaattatagttttcttattaataggatctttataattttcaatcattttgtatttaatattattcattttaaaatatgttctactaattaaataacataatgagtgaatagttgaaaaatgaggactatatttaattgaatcaccaaagattgtattaaatctatttttcatttctaatgctgcagctttactaaatgaaatgcaagaaattaaattgggatttatatttctaactaatattaaatatccaattcttataatactggataatgttttaccagaaccaggaacacttat

SEQ ID NO: 3 - DNA, 47642 bp, Clostridium botulinum
ttaagtacagtggcttcagcagaagaactttatataccaactttttgtaatgttgttactggagttactgatactacaaacgaaatatcaacaacatcatggaaatatattgatggatattggtactacctgaaaccttcaggtgaaaaagtaacaggatggattaatgataatggaaattggtatttttgtgattcattaggaagaatgttacatgatactgttattaataattttaaattaggaagcaatggagcttggatttattaataataaaataaactaatgatttttcattagtttattttatttgtaaatttggaggtaaaacatgagcgaaaatagtatatatgattttgaattagatgaaaattttaatccaaaaaaaaggttggtgatatattgcccaactgatttaatagaaaaacttgataaaacagggaagaaaaataagttaagtaaaaataaatttggacttgaaataattaaaaattattttaaagaacaacctagtatgtaacaaaatataaggagcgtttactatggcaaaatcaaaaatagacaatgaaagtaaagagttagctataacaatattaaaaacgaaagatattgatccagaagaatggttaaatgaaaaatataaagaagtaataactcaaaatagcaaaatacttatagactgtttaaaaaacagtcaaatttaagggggacaaaaaatggacgttataaatcaattagtacaattaggaaatgaagtagttaaatggatacaaactttaggagtgccttcatgtgcaattgcattaggggttggtggtatacaacaaatttttggaggtgctgaaggtgcaagaaaagctagaccttggtatactggtgcgggtttaggacttttagtaatattaggagcgtcagctatagcagcattcttaagcacaaaaattacattttaaaaaacataaatactgtgagagtttattttaaaaaatatactctcacatttattgagggataatatgaaatatattagaaatttaaaaatgttaatgaaaaatgataatgaatctaataaggaaatgaaattattacaatttttagctaatcagaaattaatactattaagtacattaatagtattttttttagtaactgttttagcaaatttacttagtaacgcagttatgtatcttattggtggtagtaaaagttttagctttcttgtatctgcatttaaatttaaattattaagttttcctattttttatatagtaatgtattcttttactgctattttattatggaaggtattttttaattttaaagcttcatttagaactattaatgatggacaaaaaggtacaagtaggtttactacaatagaagaactgaaagcccaatataggtcaattcctgaaaaaacagaagaatttgatggaaagggtggagttcctatatctagatataaaaataaaatttttattgatgatagtccagttaataatattattattggtactacacgtagtggtaagggtgaaatgtttatatttccaacaattgatatatattcaagagctaaagaaaaagcttcattaataataaatgaccctaaaggtgagttaattgcagctagtcaagatacattaaaaaagcgaggttatagaatagaattacttaatttattaaaacctatgaattctatgagttataatccattacaactaataattgatgcatataaaaagaaaaattatagtgaagcacaaagtttatgtagtactttaacttatacattgtattatgatcctaatcctaaagacccattttggatgaactcggcaatgggattagttaatgcattaatcttagctgtaatagatgaatgctttaaaaaaagtgatgaaattgaaaaagagatggaaaagttagataaaaatcataaagaatttaaagtgcttgaagaaagaaaggacaaagaactttctaaaatgacattatatacagtagccaatatgttatctgagcttggttcaaaagaagatgaatttcaacgtaatgaattagataattatttttcaaaacttgatccttcatcagcagctaaaatgcaatatgctacatcaaattttagtaaaggaacaacacgaggtggaattttctcaacagctatgtcaaagcttcaaatatttactttagatgaaattgctaaaatgacatctatgaattcaattaatttaaaagatataggctttaaaaataatgataatgaaaagcctacagctttatttatagttacacctgattatgatgtttctaatcatgttatagccagtatttttataagacaactgtactatgttttggctaaagaatcatcattaaatgattcaggaaaatgtgatagagaagtaattttcttacttgatgaatttggtaatatgccaccaatagaaggtatggctaatattattacagtttgtttaagtaggggaataaggtttaattgtgtcatacaagcctattcacagttaaagaaactatatggagatgataaagaaactattcttggtaattgtggtaatcaaatctatattttaactaatgagaatgaaacagcagaagaattttctaaattaataggcgaagaaacaatagtaacatactctagatcaggagaaatattagattcaacaaaacatcaaactgaaagtgtagattcaaggcgattattaagagcagaagaattaaggagtttaaatgaaggtgaaactgttgttgttagagcattaaaaagaagggatttaaaaaataataaaataactccacgtcctatatttaattctataaaaactacaactgatatgaaatatagatacgaatatttatctgatgaaattgacaatagcaaatctttctcaacagtaaaagttgagtcattacatgaaagtgtcgatttaaaagaattacttttatttaataataataataagagtgaatctttagaaaatagtaataatgatactgataataataagaatattattatatctgaagtatttgatgttgatgaaatttctgaaattagaaatattataagaaaatatctttcaactgcttttgaaatagaattagatacaccttttgatttatttagaaagttttgtgaaaatgaaaacaatgaacaattgatgaaatttgcagaaaaaggaataaacagaataacagaaatggggtgataatgtgaacggcttacttttatctattgaaggaacggcaagactgctacatgataataatataacacaaatagctgatgtaataagtatcggatttagatggattggttggaggataatagaattcttatctaggataataaatacactagaagcatctgcaacaaaactttgcactttaaatggattctttaatagtacagaagtaaatacacttataaatagatataaacctttagtttggatgatattaggaatatcaattgcaataattggaatgaagataatatttaaccgagttaaaaatagaggtgatttagctccaaaccttatgttttctgtttgtgttttaatattattaccagtcatgatgcttaaaatagacacaatgtctactttagccatacaagatttaaatagttataacatttcatcagccaatactatagtaaaaaacaatttacatgatatatattatttagattcagttaattataacttaacaggaaataaaaataacataagtgcaaatgatattttaagtattgatataaatgaaaaactagatactgataatataagtatttctcatagaaaaatatttaaaaacaaaattataaaagatagtaatggtagctctgtaatgaccaaattaaagcaggggtggttcctttatgaacaattttatagatataatttagattttgttgttacattaatttctttaggagctataggtataactttaatttgtatttccttaaaatcagtaagattaatttttgaaattgcagtaaataaatttttagcaacactttttgcttttgccgatattgaaagtggaaaaaaactaaaagcaatattgaaacatataggttcaatgtttgcagtattagttacaatgtcagtaatgttaaaattttatgttttgtttaattcatatttatcaagaatcgaaagtaccaatccatttgatgattttacaaaagtaatagttattcttggagtatctgttgctgtaattgatggtcctaatattattgaacaagtatttgggattgatgcaggtctaaagagtggtttaggcgttatggtaggtggttatggtgctgctagagttgttggtggaataggaaaaggtattgcaggtgaatttaagagaatgttatcaaatcctgctgaaaagcttaagaataaagttaaatcaggtatttctgaaaaatttgcaggaaataaagataaatcaggagcaggaaataataatttagctaatgaaatgaaatctaataatgacaaaagttctaataaggataaaaatttaccaacattacaagagcaaatgaataataagaaaaataataataatgaagaaaagggttctatgaaagacttaaatgatagaaataaacctatagataaagctattaataatataagtaataaagatatagacaaacctataaatgatgccataaagaatttaaataataaagataatggaaaaccaataggtgaagctatgaataacttaaatagcaaagataatggaaaaccaatggctgaagctatgaataatgtaaatagcaaagataatggaaaaccaataggtgaagctatgaataatgtaaatggcaaagataatggaaaaccaataggtgaagctatgaataatgtaaatagcaaagataatggaaaaccaataagtgaagctatgaataatgtaaatagcaaaggcaatggaaaaccaatggctgaagctatgaataatgtaaatagcaaagataatgtaagaccaatggttggagctatgaataatgtaaataacaaagataatggaaaaccaatggctgaatctatgaataatgtaaataacaaagataatggtaatctaattaatgaatctacaaagaagcttgaaaacaataaagagaatactaaatcaatgaatgaatctatgaagaaacttgaaaataataaggaaaaaaacaacttaattaatgaatccatcaatgtttctggaagtagcaaaaattcacaagtaataaatagcaaaaagaatgaatctagaatgaatcaatctgtaaagaataaaaatagtgctatagccaatgaatttaaggaaaacggaggtaaaaaatagatggatcaatatacaattccaaaagaaatttcatctgaaatgaaattttcaagaaaattttatttatttgatatagtaattttgattagttcattatcaattgcatggttatttagttcaatggtgtatacaaagataatatttttttactatatctttatattttttggaacagtatttttgttaatgagaaataagtttaatcctaaaaagcgaaattttcaaactgtatattttgcacttaaaagagatagaacagtttatacaagaatttaaattagaaaaaccatcacatattatatgtgatggttttaaatttaaataaattctaatgtttagattacacttgcatctaaatattagaatttatttattggaggtgtaaatttgaaaaaatttttagatataacaattaaaaatgaagagcctaaaaagatcaaattgaacaaggaagaaaaaaaggaacttaaagaaaaaagaaaaaaagaaaaatttgagattaaagaattaaagaatgaagaaaaaaaggtttttaagagtacaaaggaattaaatcctattgcagatgtaaatgagaatgatatttttctaaccaaagatggatatattgatatatatcaagttgaaagtaaagatatatatgcttttaaccaatatgaagcagatcttcatgtttataattttatagcttttttaagaaattatttaaatgattttaaactaatatcaatgaatttcccagttaatacatcaaggcaacaagaatatataagaaataaattagaacaaagcactaatgagataaataataaatttttacaagaaaagcttgatgaatttatgtttttggagcaatacagaaataataaagaattttttattatgttttttgcgaaaaacaaacaagatataacatctagcatattaaaaaatcaaactagaatatttattttaaaagaaataagtttagaaaagaaaataaaaatattatttaaattaaataatttaaatactaaactaatataatttgaaatttttaaaattgaacatataagttattatattaaagggagggtaaaaagtgggattaaaattttgggacaatgaagtaaaaaatataaatcataatccttatttattgagtaaaattcaaccagtggggggaatagcgttcaatccatcatcaattaggaaaggtgatggatacgaagcttgtatccatctatatgagtatcaaacaacagttaatactttttggttagaacaattattaaactttgatgatgttgttgtaacagtagatgtatcaacagctaataaacaagatgcattagaacaaattaatagatctatttcagaaaatttaacaagaattgatgaagtagcaaataatattgataaaatagaagcctcaaatactgtagataaccttacaagcttagtttatgatataacatctaaagatgaaataataaaaatagtaacaattagatattttatttcagcaagaacaatagatgaattagataaaaaagctaaaactatacttgaaagattagaaggattaggctataggggtgcaatatttttaaatgaacaagaatatgaatggaaatctttatttttaagttctacagaacaaagtaaattacctaataagagaaatgaaaaaggtataccttcaatttcttttggagggggatatccatttcatttcacagaacttaatgatccaacaggaatgtatttaggtactactaaaactggtggtaatgtcatatttgatttatttacaaaagatgatattagaaagtcatataatgcattagtaattggtctaatgggttcaggaaaatctactttattaaaaaagatattaaataataatggcatagttaacaatactataagaatctttgatatagcaggtgaatttaaaacattagtacgaattcttggtggtgaagttatagcattggatggttctgatggtataattaatccacttcaaatttttgcaacaataattgatgaagacactaatgagattttagaagaacaaagttatatgcagcatttatctaaagtatcaatgatgtatcaatttcttgcaccaaatgcaaactctaatgaaataagagaatttgaaaaaagtttaagtaatttttatagttcatttggaattgatacgagaaaagcaacacaatatgaaacaaatgagtatccaataatggaggaattgatagaatttctattgaatgagctatatgaaaatgttcaaaaaggaattttaaaagccaatataactaataataggcaagaaagattagaaaatataatattaacattagaaggaactgtaagagattatggaaagctatttaacggacatactactattaaagatataactaataaacaaatagtttcatttgaagttagaaatttagtccaatttgataaaagaatatttaatgctcaaacatttaatattttaactatgttatggaataatgctttattacaaggtcttgttgaaaagaaagcctttgatgaaggcagaaaaacaactatggaagcgataaaatacttagtattaatggatgaagcacataaatttataaattcaaacaacataatggctgttgattatttaataaattttgaaagagaagcgagaaaatattttggtggcttaatatttgccacacaatcaattcgagatgttgttccagataatacaagctctgaagcattagaaaaaattagaacactatttgaattaactcaatacaaattcataatgcaacaggataataattcaaagaaatctttagcagaaatttttgatggccaattaacagaaagtgaaatagaaactgttccttttatggggacaggagattgcattttatcaattaatggaggtaaaaatattagattccacattgaagcaagtgataaagaattagaattgtttaaaggaggagcttaatgtgaataaaaaaaatattataatagtggcattattaataagctttattttttcatttatatatattggaagtaagatatttaaaaagaatgatacaaataatgatatagccactactaataatgtaaatgaagttaaaaagaataatataaataaagaagatatagatgaaaaagaaagcaccgaatctgatttagataaaaaaattccagtagaaagtggatttaaaactacaattactggtggagataatgaacaggaagttatagaaaacaatatacttttagacaataattctacttcaattcaaaataagttagaagcaaagagagttgctgaaaattttgtacaagctatagtaagttttgatataaatgataaagatggtacagtagaaaaagcaaccaaatatgtgtgtaaaaacaaaattgatgaagtaagaagtttgtatactaatataggaaaaagtcaggatatgaaaaaaacaattataacagatttatattctgaggaagaaaataagcaagaaaataatgagtatttatatttttatgttgctgtagatgttgacttaatagataattatgatcaacaagttaaaggaactggggaaacttatttagtaaaattattaaaagaggatggacaatataaaataatagaatactattttgatgaatagaaattagattttgaactggattaagataacttaatccagtttttttaaggtggtaatagaatgggatttataaaaaaattctttaaaaaaatcctaatagcagcaataggatttatatttaatttctttttaatagtagtaacacttatgggagcttgtgctttactggaacatggaggttcaagtagtaataaacattattatgcaaatctttcaggtggaggttgcccacaagaatttgtatcttatttcaattctacagcacaattttttaatattcctaattgggtattagcaggagtagctaaacaagaaagtggatttaatcctaatgatgcatatggtggagcatacggaataatgcaaacacaaaaatatgattttgatggatctgatttgtgggatggattaatgaattgtgggctaggaaatgtatatagaagcttaggttataattttaattcatcagaagatatgtgggaacttttcttaactgatccacaagttcaaataatagcaggtgcatatgaagtaagatactatactaattatgtactttataaaaaaggaatggtttcaaaattagattataataacaatgaaaatatggcattaataaattggaatgctgatgaaaatgactcacaatttagagaagtattaaggagagtttttgcttgttataatggtggaccaggatatggaatgagagttaaattagataaagcacagaatgattatcctaataaggttttttcttattgtatgcaatttagggggaatggaatacctagtggaggtggcgaaggtggtctagtaggagataatgaaacgatagaaaaggcaataaattctggtatgagttttgtaggaaattcaccatactgttggggtggtggtagaacaaaagatgatatacaagcaggtatatttgattgttcatcatttgttcattattgttactcacaagcaggaattgaactaggagattatacttcagtcacaacatactctttaattggactaggtcaaaaagttgattcaagtgaaatgagaaggggtgatgttattttctttaataccactggtgttaatggtcatgtagctatatatttaggtgataataaatttttacatgatggttcaagcaagggtgtatcaattggagatttaaataatgattattataaaagcacatttaatggagaagtaagaaggataattcaataggaaggagtacattttaatatgaacgaaattgaaagaatagtacaaagactgcaaagaaataagttgattttacattactttattacaggatttttaatagtaggattaatattatttttgaattctaatagattacttaataaaaaatataatattataaatacagatgttaatacaaatcttgttaatcaaaatttaaatgtacatttaagtaaaaaggaatataatcctaataatagattaattaaatttaatataaaagtaaaattacaaatagcaaatcaagaaattcctataagaacagagctagttgaaaagtcaaatctaggatataaaataccaaacaatttagtaaaagtggataaagaaaattatgttatttatgctactttacctgaaaagtggactacagtttcattgaaagtaattgaagatattaaggatagtaataatcctaaattcgtaaaaatatatgcagattctagggacattaatataaaaaatgatttaattgaaaagaaagaaagtgaattagaaattgaaactatagaaaatgaaatagaaagtattaatcaaaaaattaatgaaaaacaatcagttattgaagaaaagaaattattaattgaaaaggaacaatgtaatttagctgatatggaaaaggataaaaaatatcaaacagaaaatgaaataaatgagactaatacagaaatagataataaacgttctacaattgaatttactagactacaaatagggaaattagaagatgaaagtaatgagttaaggaataaaataagtaaacttgaagtgaaaaagaacgatttaagataaaatttttacctaaaaactttgtaaaaaacttttacaaagtatgtaaaaagtatgtaaaaagtatgtaaaaaacttttacaattgggaaaaaatatgtccccacgaaaacagtaggctttgcctacttccccaccttgtgtggggacagtttccccttatgctcttaattaattttagttaggtatttaccaactaaaatttttggtcaagctttttaaaggttgtgggtgaagccataggcgagggtaaaaccctaaactggaaggaggaacattaatatttatggaaataaaggttagagatatttcaaaagaagcagttataaagattgatggcttagcaaaaaagaaaggcttaagcagaaatgaatatttaaaaaggcatttagaaaatttatcaataatggataaaattaatgataatgaagctaaatatacaatattaattgaaaagctaactaagatattagattataatacattagcattaaataaatttttagaagagaatttatttactttagatgaattagtacaagaaaatagtttaaaaggatgattattatggcaagaaaatcaaaacactttcaattatcagaaaagaattatgcttatctagaagaattaaaagaagaacgacaactaaaatatttaagtgatgcattagatttagttattaatgaacatagatgtaagggagatataactacagattatataattaagctaatagtagataaggtgtcagaaagaattgaagaaaaatttagaggaataaaaacagcaagtaattcaagtgatagaaatactaaaatattgttagagatgataaatggaatgttctttaaagcaaagtatggagagatagttacaattgctgaagataaatcaccagcattaataatagctgaaaattcagttcaaaaaagtatagaaggtagtaggattaagaaattagattctaattttaaataggggagattactaaatggttggtattgtacacaaagttagatttgttacgtctagtagtaaaaagttcaaatcttatattaattatatagctagagatgaagcaacaagaaataataattttgataaattttcactatataatgactacatgagtaatcctgaaaaatcaggttcattattcacttcaactaaagattggttagataaaaaaggaacagaacaattaaaagaagtgtttgaaaaatcgcaagaaaacaatagtataatgtggcaagatgtatttagttttgataatgagtggttagaaaagaatggattatatgatagtaaaacacatactgttgatgaaacaaaagtaagaaatgcagtaagagctgcaatggaagaacttaaaaaaaatgaaaatttagatggattagtttggagtgcatcacttcattataatactgataatattcatgtgcatattgcaagtgttgaaataaatcctagtcgagaacgtgggaaaagaaaacctaaaacattaataaatatgaaaagtaaacttttaaataatttaatagatagacaagcagaatatagcaaaataaatgatataatcagaaaaaatattattgaacaaagaagggatactgatttttttaaagataaagaaataaagaaaatgttaaaagatataataaaagatttaccagaggatcattcactttggaaatataataataattgtatgaatgatattagacctaagttagataagcttactaaatattatatagagaattacaaaaaagatgattatgaagaacttataaaagaattaaacaagggtgagaaattcttaaaagaaagttatggtgaaggtgaaaaatttagatataaagattataaagaaaataaaattaatgatctttacactagaatgggtaatagtattttaagtgaacttagaataaatgcaaaagaaaaagagcgactagaagctcgaaaaaaatttgttaataatcttaggaaaaatacaaatacaaatactttaaacatcagaaataaggatgtaaatagaattaaaaatgcaatgagagataatgtaaatcatgctaaaaatcaaagtattcataggcagctggaaagtgagtatgaatactttaattaatatattttaaggagttagatattatatgagagaagaaagtataaaagttaaaattggattatcagaatctgaatattttaaagagggagatgtacttacactaaaacaagcagatgaattgttaaaaaaacatgatgtaagaaatttagatggaacatatgaaaaagttaaatttgatataagtattgataataatatagtttatggtggcagatatgatttaggatgtgaggaaagaggtctaataggacatttagaaaaaagttgtgaaagtattaaatctatgaatgaaaatggattaacttcaaaagaggatatgaagtatttaaataatttacaagagaaaataattcctgagattaaagagattatttatgaaaatggattaacaacaaaagatgatattaataagtttgatttttttgaaacaacaaaagatataaagcttgaagatggatcactaataagaaagggaactgaatttttaattgattcatgcaaagataataaatatgaattacattttgaagaaaacagtaataatatatataataatgaatttggagataactataaatttacttttgatgatataagagattttgctgtacctacacagtattcaattaatgaatacgagaaaaataatattaaaaatgaaaatataaactatgaagaaaatcaatattatgaagaaaaacaatttataaaagcagaaagattatatgataattatattgataatgcagatattagaatggaagaaaattattcaataaaagatataaaatttttactcaaacagcatgaagagtggttaataagtaatggacaacgaggagaaaaattagatttaagcaataaggatttacaaggaatgaaattcttaaatgtagatttaagaaatgcaaattttaaaaatgcagatttaagagattgtgttatatatgcagatttaagaaatgcaaatttagaagggactaaaatagaaaatactaaatttacaggctctaatttgagtaatgcaactattgaagctaataaattagacttgattgagcatcaaatgaaagaagaactggacaaacataaatgggcatttgatggattaaaaacaaataaaaaggaaaaagaaaaagagagataaatagtcaagtatataaggtataaaatctttatatacttgaaatttaagaaatagaggagaaaatatgaaatttttaaataatttaaataaagataaaaaaataataatagttttatcttttttattacttttagtttttgcaggttatcaaactaattctacaattaaaaacataaagataaaaaatttagagaatgaaattaatgaattaagtttaaatatagaaaattcaaatagaaaagtatatgcagcatctaattttactccaaatgagaacattgaaactgaaaataaggaacaaaaggaagttattaatatagaatctaatgaaaatgacataactccatatagaactataaaagaacgttttatagatatagctaaagatattaaaaaagaatatgatgaatctataaatgatacagaggctataagttttgaaacaatggatttatcaactttaactgataatcaaataaaaaagactttagaaaaattacctaataaaaaatttaatattaaaattgaagaaaataaacttggaaataataatttttataaaataatattattacaataacggatttggaggagaaaaataaatgaaaaaggaagatgtatataaattttctcaaaaagttaagttattattacgttcattagaaggagttaaaattgaaggagaagattataaaatagaaaagataaaaagtctttatgaagaattagaaattgaaatagagaaattttcacctacaattaaagaggagtattcacttagaaccaaaattttatataatcaaatgttaaaatcaaaaaaagaatatgagaacattaaaaaatctaatgctagtaaaaaattagtacaagtagcattggaagattttaaaatgtcaactttaaaatatgaaaattctaaaaagataagagattcaataaaaaatattaattaaaaatggaggaattatgaataaagtagttttgataggaagattaactaaagatcctgaagtaaaatttacgcaagaaaatgggaaagcagttactaagataacattagcagtggataagtataattctaaatctggtcaaaaagaagcagattttgtacctatagttgtatgggataaacaagctgaaagcattggtaactatatgaaaaaaggtagtcaaattgctataagtggtagaattcaaactagaaattacgaagaaaaggatggtacaaaaagatatgttactgaagtaattgcttcagaagtgcaatttttaagtagagttaataatgttaattctgaagacaatgaaagtaaataatattaattaaaataaatcactaattttaatttagtgatttattttttatctaaaaaacatgacaaatttcttgacaaaactaatgttttaatggtaaaatattaatataaaataaaaaaaaggcagtaactaagttaccaccatatctcgcaagttatagtataacttagtttgctcctaaaatcaaggaggaaatagaatatgcaaatggaagaaataaaaaagttattaactattaataaaaactggaaagaaaaatttaaaggtgacttattagacaacctattagaaaaatgtgtagatatagagaaatacatagatttaattacaaatgaatggatgaatatatggattagtgtaacaaaagataaggaaataagaaaaatatattatgatttcaataaacagataaaagaattagacataagaagattaaaagtagaatatgaggttatttacaatatatataagtattcaaaagaattagaggattccaataatgaatctacgaataatattgagaacattattaaatggatcaatattattgatgtaaacagcttagaagaattagaaaatgcattagatgaacaaataagatatagtttataataaatttgggagtaactaagttctaccatatctcgcaaatatagtatagttactccttaacaatgaggaggaattaaaaaatgaatatgccaacaatacaagaacttacacaaataggggaagtaataataatttggatcaaatatatgttaatgcatctagcagttgctatgccaataatgtttatagtaatgaagttcttaaatgttaataaaaaatttgctaaattattaaaataattaaaaaggtgaaagatgaaaattttaatagatgaaaaacagtatttagaaataatggaattgctaaatatgattaatagagaaaaagcaactttattagcttcatttaatttatatttaaatgataatgaaagatgtttatatgaaaatgtaaagagagaaaataaaaaatatttaagtttaatgaagcaattagataaaaataaaaaaaataatataagaaaaagattaatagctgcagtagaaaaatggattgaatgtgaagtaacaggagatgaagctatgacacagataatcgaacttttagaaattaaattaaccaattaaagaaaactttaattggttataaaaaaatatatgggggggtaaaattgctaattaaaattttagagctgatattaataattattatttggagattaattaatttttctgaaaatatatttatgtatacttttagagttttaataattttaagtttattatttatgatatcagatagaaattcaaaggaatggatcatctttgttattttaatttttgctcccacatttattaaattatttaagaagttattatagatttaaagctagatattaaagaaagagagagaggatagatgagtataatattaataagtgaattaatgacaaaattaaatagtaattcatttaatagagaacagttaaatattatagaaaaatacaataataaagataagaaattgtttttaacaacgatatgtatagtatttgcatcaagtatatttgattctatttttagaattaatttaatatttgatattatagatatagttattataatattatctatgttaatacttattaggtatttatattttaaaattactatgaaaaaatcattattaatcgaattacaagaaatagaaaataaaaagatgaagatagtttaagtacagcaaccgacttgacaacgtagcgtttaaagagcgtagttagacaaccaaggacggtagcatggtgaatctaaacggagttgagagagggtttacccttattttataatagtaatagaagtacctgttttatcattaaccataatatgatgtttttaacaatattttttgtatcattaaataatgtattacatcttgtgtaaaaagtgtacaatctgtcagaaaggagtattagtgagagtttagtacttacatacactctctcactaaagataaattatgaaaatgatatatgccaactttttaattttaattttaattattccgatatcattttatttagtcatatgtaagtataatggtattaaattttttaatatgttttcagtcaatacaatggaaaaatttttaaatgaaaataataaattagcaattgctacaatattaatgatggctttatcaactgctttaacatttttaatattttcatttatgggattatcgaatattaagaatttacgatagttcgtcatactaaaaatggaggtttaattaatgttgataataatagttattattttatatataggaatatcattatattctaaacatttattatatattcaatcttatgcaagatttaaaagagaattattatataatagagaacaaaatgtaaaaagagtttgcaataaaagtgttaagaaaatagaatggatttgttttgtacctggaattaatttaataactgtacttgcattgtcaataatgatattaatagataaatactaatagaaaagtctaagcgctacgcaatactactaacggatgtggctatagataagaggttgtatcctataagttaaaaaagggagagtaagaagaagtatgtataatttaataaatagtttatcaaatggagatcaaaaaatgttttggttgatattcgacttaattgtaatagcaacttttcatctaatatggttttcatatttattttttaaaagaaaagattcggagttacaatcaattcgtaaaccattatattatagatcattacaatatatactttgcatttgcttaggtttattaatagcagcataaaaataagaattaaatatctgtaaaaatgtagtactaatttatataaattttatattattaggaggaaagaaaaatgaataaaataattagagttaaagtaagtaaagaaattagaaacattattgatttattatcaagagaaaaaaataagtcaaaaagtcaaatgttaagagaaatattaaaaatatataaagaaaataatactactagaaataaaaatgaagttgaggattattctattattattcatatacctgagaaagaaggttttactaaagaaaagtatcaaaaatatgctgataaaataacaaatgacgatattatgatcataataaatgatttatataatatacaagcttaaaagtagatatctataaaaaaggtagtgaaaatttatataaatatttacactacctttttacaaatattagtgtctataaaacatttgttttaataaacgataaaattgtacatttttaatacttaaaaagtagtataatttatctataaagtgtctattaaagtaaagtgtgtttttatagacattttatagattttaaaatatgaactttagaatatgtagattttatgtagtaactaattaaaaatgttttttgaaaattgaatagtgtagtacaaagcttatttaaaatattcctactttatcttaattatattataacgtacttttaaaagtacgttataatataattaagataaaggtaaggggtgttgagaatgaaaatgaaattaaagatagcacaagatataaattttcagggcaagtaggaagaagtattgctgtagatgaaaaattaaatttacaagttggtcaagaatatgaattctttcatgaagttgaaagctggggaaatagatggagcgaatttcatatagaaaattataatacaatagaatatcatttctcttgtatgaatgcaaaaggtcatgaagtagattatgatgaagaagaagtagaaatattagatgcagaaggttgtgaaaatgaatgtgaagtattaattcataaagatactcaaaaatttataattacttttgtatctactgatgaagattttgaagaaatgagatattatgaagttgaattaggggtagctaaataaagctatctctcaggaggtattatgaaaggtaaagtaacatttaatataagcggtagtggttctaaaagtgctaggctaacaattccagcagctctaattgaattaatgaagattacagaagataatagagaagtagaaattacttatgaagatggtaagttagttgtagagaaggtttctgaatatgttgaaggaaaatgataggcttggattattgacattgattagaaaggaaaatcataagtggagaacatattggtattacaaatgtgattgtggtaatgaaaaatggataagagcagatgcattaaatagaacgaagaaaccaactggaagttgtgggtgtttggctgaaaatacacagtttaaaaaagaggatattacaaatgagagatttggaaaacttcaagctattcgtccaacagagcagaagaggggtaacagtacagtttattgataacaatatttcagaaacggttattagagaaaaagtattgattgaaaatttgacggaagaaataactaatataaaaaaacttaagtaaagagtttataaatttatcaaatgactggaaaaatttaattaatgataaagttaagttacctaaggacaagtttactaaaagtgatggaattaaaataaaaaattcaagaaataactatgtaaagaatctaggattatatgaatattcaagtacaattaatattgatagaatagaaatatcagacgataaattaatcccattaataaatggatttgatatgaaatttgattcttcagctagtgataatataagagctatatgggcttttacctttgcattaatgcaagcatccttttatgataatggaaatcatcccaaaatgttaatagagaacttcaaactataattggaataacaatagatagtgatgaaattattaattcaatggaaaaattgaataaagaagaatataaactaattatgtttgaagacagagttataacccgtatgtaggtttaataaaataataatattttaatcaaactttatttaaaatatcattattttatttttttgccacaaaaatgaacctcccctaatctagatttttgtctaaactttgggggggcacttcataagctgatggactcttatttaataataaatcgtaatatattaattagtaatatctatatgcaatcttatattatagttatttaattctgtaacttctacttttaatatataaattgcaccatttaataaacgtattgacttggtgctatttaagagatgtaaattatgttgtatatcaattaaatcatagccgtcaatagtttcagtaactctaaataaagtacctattccttggttattactagtataaagtctaatgttagatgtatctttattattaaagttaccaggtactgtaaattcatatgaaatatagttaccaacatcaggactttgtctcgtatagtaatgttcacctgttgaattaagattatctattatattaactgaagaatttgctaaaattcggatgttaccttcttctctcttaaattttatttgattttctatattagaagaagtttgtggtactctaatgtagtaatttttattcttattaagtaaaacaactaaataacttttagcattagagctgtcaaacccagtaatataatttattgctttaatatgatcatcacataaatttccagattgcaaatttctattaccagaacctatcgcttcatatatttttaatggtggtagattattttgagcattaattttataaattcctgtagtatttactgtaaataatatataaaatggattattatctacaatatctggaatgctatatgtgtaattatctgaaatagcagtatttatttcttgtatattttcagatgggtctatgacacctactacgatttcttcctcggggccattctgtacaaatccatcttcagccacttgcgttttaactacttcagattcaggtgaaggagcattagttacttcacaatatcctaaggaaggaaggtaatactcagctgtattaataatacttccattttgatagtctattaattcatacttttcataggtattataagcctttatgcatatatttttatttgaaggagcttcttctacaaatttaaataacgatgttgatgtattaaataattgtacattgaaagcgtctttaagtctttcttcagtatattgttgtgagaattttgtattattacttgtggtgaataatggtctagttgtatttcttaatcgaggttgtataatacttcctgatgaacctgcttcgattaataatgtacctatcaaatctttatcatttgttcttatatatccatcacccttattaataacatatagtccattactataaggcaatactcgttgtgtgctactaactttagaattaaaaatattgttagttggtatatttttggtagtttctaaaatttttttatatagaaattgttcatttaaaatgcacttatcattagttaaaaagtaaaaatctttatttattttttcccctagattaaattctatagacttaacatatccaagagatggaacatatagaactgctctttctataatttcatgttgtaagacttttattatttcatatctaatgtaggtatattgtaaatacatatataagtttttatttgagggagcggttttactaaattcaaatcctataggaatttgattagcttcagtaaagttagtaaatacagtttgtatattattttttatatattcttcattgaaggatggtgttggataataatatggtatcgcattatcatttacacgtaggtccccaactattcctgttgatccattactaattacacttccacctagtatttgattttgtctagataatatccatccatctcctctgctaactacataattaccatcagctaaatcaatagtatcactatagtttataactttttcttgtatatgattataaattttttttatagatgaattcatacatttttctcctttatattttttcaagttttaacatttgatttgaattgtatatatcaaaattaggtagtaggagtagtggttggcttaaaatattttcattagtatcataaatgtcccaggcataatctaattcattcactttatttaaatttaacataatataagtatttacagcaattttaataggaaaccagtagcatttattggataatgaatctaaagaaataaatccaaagttatcgtaacttaaatacttatttggttctgctacattagagattttaaagcatctatttttagccatatattctacattccatttttgattatttgcagaagattcacttgaaaatgttaatgatcctgatacaggatttaaatataaagaaccagaaaatatagattttatattataattaccatcaggtagaaaagttctttcaactgacatataattcacctctttataaattagatgatagtactcatattaagtctttgttgatattaattttatgggttcctaataaaccatttctgattatcatctccatgataattaaatacttgaatagtagttccgtttgctgtttggctgttatataaatctagagctttagttgtatcgtgtaaattagtaattgtatatgtttcataagcatttgaaacaggatttataagccaatattgggcatcattattttgtgcaatagaagaaactcttacagtattaccatttgaagaaatccatgttagaactccatttgaaagtattgtattaaaaaactggtatgctgatttttctttattatatttaattgtccatttttgatttctaccatagtcccaagtatataaattaacacttagatctgtcatagccacttgttgtacaactttactagaatctaatattggacttattttacatgtgaaattgttaaaatctgatatcatataatcttctatgataaattttatataacttgaattattaagtgtgctaagcttcaaattacgagctacggtatcagcatataatactaagttagggtttttataacttgcaataataaatgaattgctaccaatatcttttaataataaccaatattgattatctgcatttgaatcttgttgtgctgatatattatgtgttggtgcattccatgttaaaactaaattagtattatggctatccatactttttattttataagcagctttattagcatcatatataagtctccatctttcaaggtaatttctagtttgttgaaataagctaacgttaccgacagtttgataaaaaaataaattagtatcggccttacaggagatggtaacaatttcgtcatttaatgaattttggattactgaatagtgctccattatgattcctcctttatttaagaattaatcttacatataatatataacatgatcaaattattttttgtaaacctaaaatttaaatatataaagtttttattagtatgtttacataattgattatggatatttcgtaaaaatggcttatttaaaatttaaaagtaattaattcctatatattataataaagtaatattatatatattatggaaggacagtggtaaatatgaataaattgtttttacaaattaaaagattgaaaaatgacaatagagagtttcaagaaatttttaagaattttgaaaaaactatagatatatttactagaaaatataatatatatgataattacaatgatattttgtaccatttatggtatacacttaaaaaagttgatttgagtaatttcaatacgcaaaatgatttagagagatatattagtaggactttaaaaagatattgcttagacatttgcaataaaagaaagattgataagaaaataatatataattcagaaattgtaggtgaaaaattaagattaatagcaaatagttattcaagttattcagaagttgaatttaatgatttaatatccatattacctgatgatcaaaagaaaattatatatatgaaatttgttgaagatattaaggagatagatatagctaaaaaacttaatataagtcgtcaatctgtatataaaaataaaataatggctttaggaagattaaaacctatattagtttatatttttaaaaaattttaggtttacaaaaaatagtgtggctatgttatatataaatgataacaatatactgaaaaatatatccaaaatttaagggggcgtgtatagtaaataattaaaagtatgtacgttgaaataaatttaggagagtggttaaatatgaatataaatgacaacttaagtataaattccccagtagataataaaaatgtagtagtagttagagctagaaaaactgatacgatttttaaggcttttaaggttgctcctaatatttgggtggcgccagagagatattatggtgaatctttgagtatagatgaagaatataaagttgatgggggaatatatgattctaattttctttcacaagatagtgaaaaagataagttcttacaagccattattactttgctaaaaagaattaatagtactaacgctggggaaaaattattatccttgatttctacagctattccatttccttatggatatataggtggagggtattatgcacctaatatgattacttttggatcagcaccaaaatctaataaaaaattaaattctttaatttcaagtactattccatttccttatgcaggatatagggaaacaaattatctttcatctgaagataataaaaatttctatgcatctaatatagttatttttggtccaggatcaaacatagtagaaaacaatactgttttttataaaaaggaagatgcagaaaatggtatgggaacaatgactgaaatatggttccaaccatttctaacctataaatatgaccaattttatattgatcctgcaatagaattaatgaaatgtttaataaaatctctttatttcttatatgggataaaaccgagtgatgatttagttgttccatatagattaagaaatgaattagagaatatagaatactcacaattgaatatagttgatttactagtatctggaggcattgatcctaaatttataaatacagatccatattggtttatagataattatttctcaaatgcaaaaaaagtgtttgaagatcataggaatatttataaaacagaagttgaaggaaataatgccattggtaatgatataaaattgagattaaaacaaaagtttcgaatcaataccaatgatatatgggaattaaatttaaattatttctctaaagagtttagtattatgatgccagatagatttaataatgcacttaaacatttttatagaaaacaatactacaaaatagattacccagaaaattatagtataaatggttttgttaatggtcaaattaatgctcaattatttttatcagatagaaatcaagatattataaataaacctgaagaaataattaatttattaaatggaaataatgtttcattaatgagaagtaatatttatggtgatggattaaaaagtactgtagatgatttttacagtaattataaaatcccatataatagagcctatgaatatcattttaataattcaaatgattcttctttagataatgttaatactggagtaatagacaatattccagagattatagatgtaaatccttataaggaaaattgtgataagttttcaccggtacagaaaattacaagtactagagaaattaatacaaatataccatggcctataaattatttacaagctcaaaataccaacaatgaaagatttagtttatcctcagattttgtagaggtagtttcttctaaagataaatctttagtgtattctttcttatctaatgtaatgttttatttagattccataaaggataatagtcctattgatacagataaagaatattatttatggttaagagagatttttagaaattattcttttgatattactgcaactcaagaaattaatactaattgcggtattaataaagtagtagcttggtttggaaaagcattaaatattttaaatacatcagattcttttgtagaagaatttcaaaatttagggccaagctcacttattaataaaaaagaaaatttaagtatgccaataattgagattgatgaaatccctaactatatgctaggattaccactaaatgatttaaatgaaaaattatttaacatatatttaaaaaacatactttatttcaaaaaagtttatttcaatttcttagatcaatggtggacagaatattatagtcagtatttcgatttaatttgtatggcaaaacagtcaatactagctcaagaaaagctaattaaacaaataatacaaaataagcttcaagatttatctaaagctgatatatcaatggataaattaaatctaatgaacttagctacagggaaaacttttatagatttatcaaatgaatcacaaatagcaatagataatataaatgattttttaaataaatcagctatatgtttttttgatacaaatatatatcctaagtttatttcttttatggaacaatgtattaatagtgtaaatagtaatgtaacaacttttatacaaaagtgcactaatatcactgaagatgaaaaattacaattaattaaattaaatacatttatgaatatagattttgagttttttgatattcaaaatattaaagatttaattacttctgaaactgatttaattaaagaagaaaaagaatcggattataacctatttttgcttacattacaggaagataataataaagtaattgaagacatatctggtaagaatacattagttaaatattcggattctattagtttagtttatggagtaaatggagatgcattatatttaaaagaacctaatgaaagtgttagtttttctaataaggtttttgaaaatgggttaactaatagtttttcaatttgtttttggttaagaaatttaggagaagatattattacgtctaaactaatagaaaataaagctgataattgtggatgggagatttattttgagaataatggattagttttcagtattgtagattgcaatggtaatgaagagaatatttatttatctgatgttataagtaaaaattggtattatatatcaatttctatagatagattaagaaatcaattattaatatttattaatgataaacttattgctaaccaaagtattgaacaaattttaaatatttattcaagtagtacaatttctttagttaatgagaataatccaatatatgttgaaggattatctattttaaatagatctattaccagtgaagaagttgtaaataattatttttcttatttaaataactcatatataagggatatttctggagaaagattagaatataataaaatctatgaactatacaattatgtattcccagaaaactcgttatatgaagttactgaaaacaataatatatatttgtcaattaaagatacaaatgaccttaatattcaaggtgctaagtttaaattaataaatattgacacaaataagcaatatgtccaaaagtgggatgaaggagtagtttgtttattaggagatgaagaaaaatatgtagatatatcctctgaaaataatagaatccaattagttagctctagagatactgcaaagaaaataatatttaataacgatatatttaagcctaactgtcttacatttgcttataataataaatatttatctttatccttcagagatagaaattataattggatgatatataataataatgacaatatacctaaagctgcacatttatggacattaaaagggatataaacttaaaataaggaggagaatatttatgccagttacaataaataattttaattataatgatcctattgataatgacaatattattatgatggaacctccatttgcaaggggtacggggagatattataaagcttttaaaatcacagatcgtatttggataatacccgaaagatatacttttggatataaacctgaggattttaataaaagttccggtatttttaatagagatgtttgtgaatattatgatccagattacttaaataccaatgataaaaagaatatatttttacaaacaatgatcaagttatttaatagaatcaaatcaaaaccattgggtgaaaagttattagagatgattataaatggtataccttatcttggagatagacgtgttccactcgaagagtttaacacaaacattgctagtgtaactgttaataaattaattagtaatccaggagaagtggagcaaaaaaaaggtattttcgcaaatttaataatatttggacctgggccagttttaaatgaaaatgagactatagatataggtatacaaaatcattttgcatcaagggaaggctttgggggtataatgcaaatgaaattttgtccagaatatgtaagcgtatttaataatgttcaagaaaacaaaggcgcaagtatatttaatagacgtggatatttttcagatccagccttgatattaatgcatgaacttatacatgttttgcatggattatatggcattaaagtagatgatttaccaattgtaccaaatgaaaaaaaattttttatgcaatctacagatactatacaggcagaagaactatatacatttggaggacaagatcccagcatcatatctccttctacagataaaagtatctatgataaagttttgcaaaattttagggggatagttgatagacttaacaaggttttagtttgcatatcagatcctaacattaacattaatatatataaaaataaatttaaagataaatataaattcgttgaagattctgaaggaaaatatagtatagatgtagaaagtttcaataaattatataaaagcttaatgtttggttttacagaaattaatatagcagaaaattataaaataaaaactagagcttcttattttagtgattccttaccaccagtaaaaataaaaaatttattagataatgaaatctatactatagaggaagggtttaatatatctgataaaaatatgggaaaagaatataggggtcagaataaagctataaataaacaagcttatgaagaaatcagcaaggagcatttggctgtatataagatacaaatgtgtaaaagtgttaaagttccaggaatatgtattgatgtcgataatgaaaatttgttctttatagctgataaaaatagtttttcagatgatttatctaaaaatgaaagagtagaatataatacacagaataattatataggaaatgactttcctataaatgaattaattttagatactgatttaataagtaaaatagaattaccaagtgaaaatacagaatcacttactgattttaatgtagatgttccagtatatgaaaaacaacccgctataaaaaaagtttttacagatgaaaataccatctttcaatatttatactctcagacatttcctctaaatataagagatataagtttaacatcttcatttgatgatgcattattagtttctagcaaagtttattcatttttttctatggattatattaaaactgctaataaagtagtagaagcaggattatttgcaggttgggtgaaacagatagtagatgattttgtaatcgaagctaataaaagcagtactatggataaaattgcagatatatctctaattgttccttatataggattagctttaaatgtaggagatgaaacagctaaaggaaattttgaaagtgcttttgagattgcaggatccagtattttactagaatttataccagaacttttaatacctgtagttggagtctttttattagaatcatatattgacaataaaaataaaattattaaaacaatagataatgctttaactaaaagagtggaaaaatggattgatatgtacggattaatagtagcgcaatggctctcaacagttaatactcaattttatacaataaaagagggaatgtataaggctttaaattatcaagcacaagcattggaagaaataataaaatacaaatataatatatattctgaagaggaaaagtcaaatattaacatcaattttaatgatataaattctaaacttaatgatggtattaaccaagctatggataatataaatgattttataaatgaatgttctgtatcatatttaatgaaaaaaatgattccattagctgtaaaaaaattactagactttgataatactctcaaaaaaaatttattaaattatatagatgaaaataaattatatttaattggaagtgtagaagatgaaaaatcaaaagtagataaatacttgaaaaccattataccatttgatctttcaacgtatactaataatgaaatactaataaaaatatttaataaatataatagcgaaattttaaataatattatcttaaatttaagatatagagataataatttaatagatttatcaggatatggagcaaaggtagaggtatatgatggggtcaagcttaatgataaaaatcaatttaaattaactagttcagcagatagtaagattagagtcactcaaaatcagaatattatatttaatagtatgttccttgattttagcgttagcttttggataaggatacctaaatataggaatgatgatatacaaaattatattcataatgaatatacgataattaattgtatgaaaaataattcaggctggaaaatatctattaggggtaataggataatatggaccttaattgatataaatggaaaaaccaaatcagtattttttgaatataacataagagaagatatatcagagtatataaatagatggttttttgtaactattactaataatttggataatgctaaaatttatattaatggcacgttagaatcaaatatggatattaaagatataggagaagttattgttaatggtgaaataacatttaaattagatggtgatgtagatagaacacaatttatttggatgaaatattttagtatttttaatacgcaattaaatcaatcaaatattaaagagatatataaaattcaatcatatagcgaatacttaaaagatttttggggaaatcctttaatgtataataaagaatattatatgtttaatgcggggaataaaaattcatatattaaactagtgaaagattcatctgtaggtgaaatattaatacgtagcaaatataatcaaaattccaattatataaattatagaaatttatatattggagaaaaatttattataagaagaaagtcaaattctcaatctataaatgatgatatagttagaaaagaagattatatacatctagattttgttaattcaaatgaagagtggagagtatatgcctataaaaattttaaggaacaggaacaaaaattgtttttatctattatatatgattctaatgaattttataaaactatacaaataaaagaatatgatgaacagccaacatatagttgtcagttgctttttaaaaaagatgaagaaagtactgatgatataggattgattggtattcatcgtttctacgaatctggagttttacgtaaaaagtataaagattatttttgtataagtaaatggtacttaaaagaggtaaaaaggaaaccatataagtcaaatttgggatgtaattggcagtttattcctaaagatgaagggtggactgaataatataactatatgttcagcaaacccattttatataagaaaagtttaagtttataaaatcttaaatttaaaggatgtagctaaattttaatattaaataagctacatcttttagtttattcattataagttgtttgaatatatcttatgtacaaaaaattattatatattggtattaaaaatatgaagtcaataattgctattgaaaatgctaataaataatagagatgcaacaatatagtgaataaggaatgatgggaaatactttagtaccaaaaataagagataagtgtgataagtaaatagatgatagcaattaggataatgattgcagaattattgctatcccaagtattttatatgaaatagcaatacgatgtttttaaaaagaatactataatttttaatagagaggtttaagagttcgtaataggaaatataatttagtaagatttgagagtttagataaaatagatattaataaatgataaaatatttatgactttataatttataaattgaagtttcagttattatattatttttaaggagtttacacagattatgtctttttcaagaaaagaacttattaaacaattaaaactacaaatgcaagagatgcttaagaaacattagaggatttatttacggatacatttaaagaaatgttagaagcgaagcttgacaatcatttaggatattctaaatatgattataaaaacaaaacatttcaaatagtaagtgtggttgtagttataaaaagtattattagatttaggagaatctgatttaattttaccaagagatagagaaggatcatttgaactgtaggtgtagctttgaaacaaagttatatcgttttataataagtgatcttgaatcttttataaaggagaacatatagaattatgatatttggatatatgagaattagtactaacaaagaaaaacaaaagactgaccgtcaagaaattactttgataaattattcaaaagaaaataattttacatttggtgatataataccagaaaaaattagtggttctgtaaaagcaaattatagaccaaaatataaatcattgaaagagaaattaagaagtaatgatattttaataattacagatgtggatcgtttaggtagagatgctgatgatataataatggaatttaaaaatttaaaagctagtggtattagaataattccactagatgttccttatttaaatcaatggaaaaatgtaaaagatgattcaatgtataatatgatttctgatatatatattacaatcaaagctcatcaagctcaacaggagcgagaaaaaatagttgctagaataaatcaaggattagatgcagctagagcaaaagggacaaaattaggacgaccatcagttaaaatagatccaaattttattagagaatatacaaaatttaaaaatggaatttatggtgatattacagctactaattttgcaaaaatgctaggtataggtagaagtacattatataaatatataaaaatattaaaaaatcaagaataaaaaagctcttaactttaagagcttttttattcttgattttttatgttgaaattctttagattgctttccttaatcataaaatatgagttattattaaaaggtgaagggaaattatgttaaatatctaatataattatatatgagtaaaatgaaaactgaggtataaaagaatgatatatggatatgtaagagtaaataccaaagaacaattaaataataatagtatagaaaaacaaatatttgaaatatttgatgtatattcaaatgctattatatatgaagaaacttttaataataaatttacagtaagacctaaattcttagaattactggatttattaaataaacacgatattttagtagtaacagaattagataagttttgtacaagcataaaagagggattaaagtatataaagatgcttataaataatggagtaaaagtacatatattaaacatgggaatgatagaaaatacatcaataggaaatttgataattaaaaacttaatagcatttgataaatttgaagaaatgattttaaaacaatattctaaaaataaggatggtagacctaaaaaatttacattaattcaattaaggtatgcattatcattgcttaaagttaatggagggaaaaattcgtataatgaagttgctagaataacaggtatttcaaaaagtacattaattagagaaatgaaaaaaatgtcatgaaaagcttgactaattatattatgcgtagtatatatagagattaccttagatattgcgtacagatattttaaagcaaaaaatttaataaagttgtttatataaacaacatgacaaaaacattgacgattaacattagatatagtattataattgtaaggaaatatttagatcttattatctttaattatggaggataaaatgaaaaaaacaaaaattgaaataagattaactgaggttcagaaagaagatattaaattaagagctaaaaataaaagtcttaaaatgagtgaatatatcttaaataagatatatgagaatccagaatcaacaaatgatataaaagacttgcttagatttaatataaaagagttattaagattaaaagttgaatatttgaatcaaaaaaaagaatgtgatgatgcaaataaaaataaaaaaatagaaaataaattagttgatttagataaaatcataacaactttaacagcaatgcttaatgatgaagaatttaacttttaatatttatgaatataagtaattagggaagaagattttataaagcatattttttattcagctgatctttatattcttgaagataaagctgtaattagttatagaattaaatattgataaagtgaattgaattaatttacattttttcaaattaagaattagataaattgtgattttttttaacaaagtaagcagattatagaaatttaattgtagaattaataaagataatccagtcttatgaaaaaaatattgtaatttatccaaaaaaaagataaaataagtacatggaaaaattaaataaaaaaagctctaatcaaactcttacaattagcctgagaaactaatttgtaagccaacttagtaagtaccgcaaatactttaaaaagctgttttggatgaaaagaactttatacaaattattgtattcaatttatatgaatataataacaagtttagagaacaatttcaagcattttagtataaaaagtacatactaaaatgctttttttatttttaaatttttaaataaacatttttttaaaaaaaaattgtataattattccaaaaaaatgggtaataaaaaagcgaacttaaatggctctttatattggaacgtagttcctgtatcttttaggaaggaggatacctttatgaccttacctggacattcacaaatattacataatttatataaagaacatgacaatggttatgtggctatttttagaaaaggctttaaaggtatttatcagaggcattataagaaacaggacttagaagaagctcttgatgttttttttagtggtggttataacaatgaactttatatttctatgaacacttttttaaaacctaatagaacttctgagaacttaaggtatttaaatgcactatatattgatatagattgctataaattaaatattagaaaagagagtgttttgttttttctagaaaatgatttctataataaaataatacctgaaccaagcgtggttgtagatagtggtaggggattgtatttagtttggtttatagagccagtaccaagcagagcattaactttatggagagctatgcaatattatttatatagtgcattaaaggaatttggagcagatagagctgctttagatgaatctagagtattaagggttgtaggttcatataatagtaaatctgattcttatgttaaaattgttgattttaataattttagatatacgctaaaagacttaaaatctgaatatttacctgaaataaaaaaagaagataaaaagattaaaaaaaagagaaaatctaataaaattcatattttcaatttttatggtttgcataagtcgagaatggaagatatatataaacttgttcaattaagaagctatgatatgaagggaaagagagaactaattttatttttatatagatattatgcaactttggtagaaggtgaaactgtagcagaagaaatgactttagagttaaatgaaagtttcatagaaccattaccattaaatgagataaattcgacaaaaagtaattatattggtaaatataattataaaaataaaacgctagtagagttattagaaataagtttagaagaaatgaaacatatgacttcattaatttctaaagaacataaatttcaaagaaataatgaaagacgtaaaagtttaagaagaaatgaaaatggattaactaaaagggaacaattaaaaaaggataacttaattaaaataattaaacttatggatgaaggtagaaaaactaaagaaatcgctgaaaccttagatatttctttgcgtatggtacaaaaatataaaaaagaacttaaagaaaataataaattatatgaagatttaaagaaagaaattttgtctataaacgacaattataatgaagatgaaattcaatgctatgatattgacttgaatcttgaagaaatagaagaaatttttaatgatgatttaaaaaaggtgggtagttaaaaggttatttttaggaggaggatatgtttagtaaagctttcggatttatatttaaagctataattagttttgtagttttaattgtttcaattaagtttctatgggtttccatactaatatttattgatagagtcgttaatatatttaatattatagggtaatatttgatatattaaatttaagaagtacaagctataggaggtcattatgaaaagcaagctattaaaaacaatagcactaacattaataagtgttaatactattgtctatccaatatacgcagctgaagtaccaaagttctctaatctaaatgatgtagaagaaaatatatatactcatttaataaatagagattcaaacataaattttatttatacaggttcaacacgagaatttaaggataatattgttaaaactataaaagcagcttattctaaagatgattacactgaaagatcatggctagaaataaagccaaatgtaaatataagtgatggaaaaattaatacaagcattaattttgaatatttaactaataaagaacaagaggaatttattgatatagaaataaaaaaaataactgataaactaataaatgataaaatgtctgattttgaaaaggtaaaagcaataaatgattatttagctaatagatatgagtatgattatacattaagttcatctaatgtatatagtgcattaattactaattatacagtatgccaaggatattctttaacagcatataagatgctaaagaatgcaggtattgagagcagaataggggttggcactaataagggagcttcacattcatggaatatagtcaaaatagaagattcttggtatcatttagatattacaaataatgattctacaagatctaataagtattttttggtaagtgataaatttttagaagacaataattataaatggaataggacagaatacccagaagcactaaataataaataaaataatgtattaaaaaaataaaaaggatttttaatttttatgaagaatatgtaaaaaaagaatattgttatactttgatatactatttttataaaaacatatttaagtataaaaaatgatatacttttatatacttaaatattgacaataaggggaatgtagtatataattagtatattaattgatatactaattatataaagtataacaaagtataataaaatgcataggaaaagaggtaaaattatgaatattggtattgatttagggaatggatatacaaaatttaagggaaagaaatttgctagtaaggttaaaatgggtagacttgctaattttggtgaaaaaaataaagaagttcatgaagtaaaatacaataatgcaagttatgttgttggtgaaggacaatttttcataactgacgatagatattttacaaatgaatataaaatatgcttattaacagctatagccttagcaagtaatgaaatagtaatagaagcaaatatatgtgtaggattgcctgttatgaaatatatgagtgatgttaaaaggagattagaagatcatttaaatactattggagctgaaaagataacagttaatggtgaagaaaaaataattcatataaaaagtgtaactgtatttgtagaaagtgcactagtagttaaagatagaagtcaaggaaatgaaattactatagatataggggcaggaacagaaaatattattcaatgggaaaatggtgtgccagttaattttgacactaaaaataaatctttctataatttatataataaaatatctaaatatttaaaggatgtaggaaaaggtgatgtttcaactgaatatatagaaaaaactttaggacaagatgaaataattattaatcaagaattagtagatataagagatactcataatattatagaacagcatgtaagagaattagcatctaaaatcatttctgaatttgatatttcaagagcgaggagaatccgattaatgggtggtggtggcttaccaacttataagtattggaaaaatattattgaaaaagttgaacttgctgataatgctcaattcataaattcagaaatttatgaaacagtattagaaatgagtggaattaatgactaataatcaaaatagtgcaaaagaaaaaaaaagagatttaaaaccagtgtcatttaattatgacaatgaacgtgatgttaaattattagaatatgctcaaaaagctggaatgaaatttggcacatatgttaaatttttaattgaaaaagaaatgaatggtagtaataataataatttagatattaatagcatagcaaatgctattaatcaacttactaaagtaatagaaagcaaaagctttgtaacaaattcaatatcttcagataatatagatgataaaccaaaaaaattatcagataaagataaagaaactaaaaatataataagtggaattttgaatatgaatagtaaataaagggagttgtattttatacaattccctttttcatatataaaatttattgtttactaagtttagcaccatcgagaattccttgtctatatattaattcttctccgataccttcttgcatattatatagattttctagtttttctaataaaaatattttttcatctggaatatgtttttttattaagtttaatacattaaatatgttcttatctaactctaaataagcttcgtttgaggttataatattagtaaagtcctttaacatttattagtaatccttctttctatttttttgaattaacacgtgttaaataaatctgtaatgttttcagacctgattatatcacaaaaagctataagaaccatgtatatattagacaaataaaaaggaaatatgttaaatttcaacattaaattacatttgaatttgttgtataataaataaaaatgacgaaatgtgaggaaaattggtgaatttaataaaaaaacaaagaataaaaaataaaattagtcaagttgaattagcgaatctatgtaaagttaaacaatcacagatttctagaattgaaacaaataaagaattaccttcagcaaaattgatcgtaaaattagctactaatttaaatttatgtccttcagatgtattttctttcttttatgagaataataaatgtgattttagtgaaaacgataaatgtaattctaataaaaatgaaaaggtataaaaaaggatgatatgttatactaaaatagaaatatattatattggatggtgagttatgaaggggaatgttttgattttttctaagaatttaaagaaattaagaacttttaataaaatgaaacaggaagacttagcagtaaaaataggagtagcacgttctaatatttcctactatgaaacacaaaaaagcgagcctactctaactcctttgataaacatagcaaatatatttaatgttactataaatgaattggtcacagttgaattaacagatgatattatacaagaaaaaaatcaacagcaggataatataacaaaagttttttcaagctctgaaattttttctaagaatttaaaagaactacgtattggaaaaaatatgtatcaaattgaattagcgaaagaagtaaaaacatctaaatctaacatatcattttatgaatctggtagaagtgaaccaacactaggtgtattaatgagaatatgtgatttttttaatattaaattatcagaattagtttcaaaggatcttaaacctactgaatggataaaatcggaatctgattttattaaaaaaattagctatgacttagaatctgtagagaataaagacgaaaattttcttaaatttttatatgaacttaaagaatattatttaaatcaatctaaaagattagaggaattagtacaaattaaaattcctgctaaattgaaagaaattgataatattatagagtttgtaaaagagaaaagaaatgaataaatattcttagaatgaaaagaagttacattaagtaacttctttttatattctccttttgtcaatatagtaaatttaatttaaaattatatattgacacagtggaaaatattgtgatataatcatgtcatagaaaaaatattgcgaggagaaaatagaataggtgtcaagtcaatttaaaaaaaatagaaagaataagttaattgacttaagagtaaaaaacaatttatctagaagttatgttgctgataaaataggtacaagcgaagattgtatagcaagaattgaaaatagtaagcaaaagataatactagatgaacatgctgttcgattagctaaagtatatagagtaagtttagatgatatatatgtagcaagtattcaaaaaagcgaattataagaatgtcccttttttgaaaaatttgccatactatatctttttttattataaagttttttaggaggatttttaatgttagataagaaaaaggtaagattagataaaaaagaagttaagaatttattcgttgctggatatatagcatcggaaattgcagatatattaaaagcaaaagtagatacagttaaaaaatgtatagatagaaattttaaaatagaggaagttctttctatacataaagaaaaaagaagaataaaaaaagatataaaaagagtaatatcaaatactagtaatagatacatgggaactgaacaacttataaaatataatagaagcagttttaacatgaataaaaatggagtgctagtatataataatgatcatggattagcaccagttgatctaccacaaaggtttaaaccagttttagggtagctctttttttttgcttaaatttagaagaaaagatgtgaatttaatgttttttaaagatataaaagtaaaacatggaatatatgtaggaatagctccaaaaggagaacaagttatatttaataaatttaatagaaataatcagggaaattctttaacaataggagttccaggtaggggaagtgagtttaatatgacaactaaatttataaatacaaatgattaaatttaaaagtttagatagattatcagtaaattaattataaaatcattagtttatttttttggcttaaattaaaaattatattaggaggaattagtaatgaaaaagaaattaatagcaggtgtattagcaacagcaacagttgtaggaggagtaattccaactacagcttttgcagatgtaaaagaagcagataatcaaataattattgaggaagtacaaaatgtattaccagtaattgaaagtgaatcaacaacaggaagtgcgataaaaatagaaaatgatgataagaatttggaaaatgaagatattgatgaaatacaagatcttaatcaaaatgaagaaattatagtggatgaacaacaagaaatagggatttcagaagtcaaagaattaaaagcaactatagatgaaaatataactattggagaaaaagtaaatgtaaaagtaattggatttaatgcaactggtgaagaaataaaactagataaagaaaaaatttcatacaaatggtttgctgataaggaaatagtaggaaataatgattatttaaatataacagatgatatggctaatagagaaattagttgtagagtagattataggaattagggggagtaaagatgaaaagaaaattaatagcaagtttattagtattaggtgcagttgtaaatattattccaaccgaaggggttatggcagccactacagtttcaactaatacaaattcagtagtagctaggaatgtaaatagtaaattaaatcatagaataattaatacacctatagggaatgttgattgttattcgtatacaagaggaagtgaaaaaatacctttattaggtaattcgggatatgaccttgtaagtataggagggtattcaaatcatagcaaaagtggaagtagttcaagtacaaattattatgcattagtagcaaatgaaggtgatccaataacattatcactagcagcagatggaaaagatggtatgtctatgactgttgcagatacagaatgttttagagcacgtcgtaatgataaagctgacaatggttataagggtgcttcaattacatttaaaatgcctaaaacaacacttgattataaaatacaaacagtatatgacgacaaaggtgtatcgtcacatgataaatataacacatactttctagcttgtaagggcagtagtaatttttctgaacagggagcaagtatagcattagagtcattattaaatactacagttacaaattcaacaactatagatgacttaaaaaaggaaatgcaaaaaaatcttaattcatcagaatttactatttcagcaactcaaattaaccaagtaaaggcaacagaatcagcatcaggtaaattagaaggaaatgcaacagtagtggatagtagtggaaattcaaaaacatttaaatttaaccttcctatatctgcaacaggacagagttctaatacattaatggaaagctataaaaattcaataaaaaactttaaaggaactaatactaaaaatcaaaacaatattttagatcttgtaaaaaagacaaatgatgatatatcagtaagtatttctaatttcaagaaaacagatgctactgataaagttgatggtaaaattactggaacattaaatataacaggagtcgctccttataattttaatatagaaataccaagattggcacaatcaactgatacagctaaagcaatactagaatttgtagtagaaaatatgaatgtaacaaattctacagataaagctagtattcaaaagttagtaaataattctatagatacatctgttgttacagcaaaagttgatttaacagatgtgaaaaaggcaacagaagctaataaaggaattattgaaggaaatatattaattgaggataaaacaggagttaaagctactattcaaattaataaagaaatagaagtagaaactcaatcattaagtacggttaaagacttatataaagcttatttagacactatggaaaaaaccaatagtacaacagaacaaagcatcatagatgctattcatattacaaatgaaaatataaaagtaaaaatttctgacttcaaagttaatgaagcaacagaaactagcaaaggatctattcaaggattaatagaaattcaagacaatgaaattggcgaaaaagatacagtaccagttaatctaattatagattatttacatcaatcagcaaaaacagttgtaggattatatgtagaagcagctaaaaattatatagctacaaatgatacaaatgaacaagatattattaatatgatatctataacaaataaagatattaaagttacttcagatagttttaaattaattccatcaacagatgaaagcaaaggaaaactttcattgaatcttaatatatcagatggagaaaaaaatatagtacaaccattacaaattactattaataatcaaccacaggaattagctactgcccttgctgaaactcaaaaacttttggcacaatataagataactactgatgatatagatatggatgatttacttattaaaataaatgataatataactaatccatctattttcgcatcttatagtaataatgatggtgaaagaatagagaaggtaaaagcaactcaagataaaaatggatatgtaaaaggttcattgcttttagctgatagtaagggtcataaggttatgataccagttaattttgaaattttaaaattaagtcaatcactagataatgctgaaaataaagtaaatgaatatttaaataatttaaaagctaataatgagttaaaagaatctgatgtattatttgatattcaaaatcttttagacagcagcataacagcagaaataacagattataaagtggatgcagcaacagaattatctaaggggatgataactggtaaggttctattaaataaagatggagaaagtagaaaagtagctataaatatagaaataggtttacaagctcaaagtatggaaaatgctagtaatcttattactgataaattaaaggatatgtatttaactaatacatctacagctaaagatttagaaacagaattatctaaatgtattactggagcagaaggaaataaaataaaaattaaagttgcagatgatgattttagaatgatgaaagctacgcaagatagtgatggatcagtacgtggaaaagttactttatttgatagtaatatgaatatacagtacgttccatatactattaaaattaagcaattagcacaaactttggatcatgctgctagtaaagtgaatgaaaaattaaatagtcttaaggcagataataaattaactaaggaagtctttacagaagatatgaaatctgtaattacaaattcggaaggtagcaagataataattgttaccgataaatttgaacttactgaagctacagaaaaaataccaggtaaattaattgttgaagttactgttttagatggatcatctagtaaaactttaggaaaaacttatgaaattgcaaaaactaatcagagtgtagaagatgcacaagatacaatagatgaaatagttcttcctaacattaaagttgataataatacaagtgttgaagatataaaaaatcaaataaaagattcagtaggcgataacatagatgttgatattaaagattttaagaaagatgaatctagtaataaggaagatggtaagataacaggaactgttattattacagacaaaaatacaggtgaaaaaatagaaataccaatagatataactattcctaagattgaggaaacactagacgaagcacaagatacaatagataaagttcttccgaatattaaagttgataataatacaactgccgaagatataaaaaatcaaataaaagataatgttggtggtaacataaatgttgatattaaagattttaagaaagatgatgctactgaaaaagaaaatggtaagataacaggaactgttattatcacagacaataatacaggcgagaaaatagaaataccaatagatataactattcctaaaattgaggaaacactagatgaagcacaagatacaatagataaagttcttccgaatatcaaagttgataataatacaactgttgaagatataaaaaatcaaataaaagacaatgttggtagtaacatagatgttgatattaaagattttaagaaagatgatgctactgaaaaagaaaatggtaagataacaggaactgttattatcacagacaataatacaggcgagaaaatagaaataccaatagatataactattcctaaaattgaggaaacactagatgaagcacaagatacaatagataaagttcttccgaatatcaaagttgataataatacaactgttgaagatataaaaaatcaaataaaagacaatgttggtagtaacatagatgttgatattaaagattttaagaaagatgatgctacagaaaaagaagatggtaagataacaggaactgttattattacagacaaaaatacaggagagaaaacagaaatatcaatagatataactattcctaaattagataaaccttcaggtggttcaagtagttcacatcatcataaaaataatgatgaattagatgattttggaacaataaaaaatccaataacaaattcaaatgaaagcaatcataaaggttggactagcatgaatggtcgttggcatttctttgatgaaaaaggaaaagttaaaactggttgggttaacgataatggaaattggtattattttgattcatttggagtaatgcaaacaggatggcaatgtatagataatgaatggtattacttaaatcctgttgctggacaagggttaggagctatgcaaacaaaatggattaatgataatggcaactggtatttctgtaatgatagtggaaaaatgcttaatggttggattaatgataatggcaactggtatttctgtaatgatagtggaaaaatgcttaatggttggattaatgataatggcaactggtattatctaaaccctaaatcagacggaactaaaggaaaaatgcttaatggttggattaatgataatggcaactggtatttctgtaatgataatggaaaaatggcacatgatacttttgctaatggatatgaattaggtagtaatggagcatggattaaataataaaataatctgtttagataaactaaacagatattagaagggaataaaaatgggaaagaaaaaaaagttaacaggaatgctgatagtatcactattaatgattagtgga

SEQ ID NO: 4 - DNA, 148780 bp, Clostridium botulinum
agaatccaaattacacctcctagttatgtttaacttctacattatatgtatttaaagcattgaaagcataaaaaataaactagaaaaatataagtttaacttgtacattagatgtatttaaagtttaaagattataagttaaggatatgtttttaatgcttaacttttgcattagatgtatttaaactattgattgacaaaaatttttagttttatttaagcttaacttttacattaggtgtatttaaacggaggtttttgtaatgctaaatcctataaaaaacaagtttaatttgtacattagatgtatttaaactaaataaggaacctactaattttttattgttattaaagtttaacttatatattagatgtatttaagccctccatttctaaactataattaattatgcttaacttttgcatacgatgcatttaaacctttatgtgagttcttttttattatattgttattgagcaagaactccaattttactgttttataaattagtttaacttctacattagatgtatttaaaattccgtttttttaaaataggaaatttttaataaaaaaagacttttaacttctacattaaatgtatttaaacacgcatatttgaaatatggaaaatggagtaagatggatttaacttatatattagatatatttaaactaccgatttataaaaatttttagttttatttaagtttaacttctgcattggatgtatttaaaaactttcagaaggcatattttcttaaatatttggtttaacttctacattatatgtatttaaacgttgtaaaatatgtaggtggagctaaggagtgtaagtttaacttctacattagatgtatttaaagtaccgtttttagaaaaaagattgtttcatttacacatataatatataaaaaagcaaatagctatttgaattattaagctatttgcttttttatatattactttcaataaatcttctaaattaagtcctatttttgtagctagtttcatagctatcctttctaacataagactttcttctagtgataaattttttcttatttttctttacactgattgataattgattctatttcttcataatcaatttctccatctccatcaactatacattcagctctaacccattctgctatattctttagcatcctttttgctgcattattttctcttgtacttaattcttccctatctgttaatacatttaaacactcctctagatcctctacagtgttttggaaacgacaataactcatattactcattatataaaactcccctctcttttagctattaaaaagccataattcatcatttaattaattattaatacttttttctatctttttactgtataagataataaacttactatgtgaatataaactttttaaatatactttaaaatattgttttatatatttattagtttgaattatttggtttacattttattaatttacataatatttaatatgtatctatatagttgtattatttttatataactaatttagaagtataatctcttacaaatcatgtatgtttttttatttttgtaataataattttatataaaaacgatgtagcaaataacaattattgaaaggagaaatcttcattgtgaaaaattatcttaaaaattatgttaatcatataatatttatatgtattgcagtagaaatactctctttagtaattttgatttcaagaaaatgttccattgaaaatattatattgttatatatcttgccatttatattagtattatttattaccattctaaataattttaaggatagtaataaatctaatattgatgataaatatgaattaattgataccttggatttatatcgttcaaaaaatcaatttattcagaaaaaagaaattaataatgatactatatactgtttttcatgcatcgatagagaacaaaacatttctacagaaatcataaaagagaataccgaaaatcatgttatagtaaagaaaataaatcattataaagcctatgttgaaatttataagaacatatatgataaaaaaaatgtatacattatttatttaccaaagcgtcttgcacttacgtagaaaaactctccatatataatttcaattatatatggagagtttttctattaaacttattgttttttactgcagcacaagtcatttttaaatttgcactctgttagagcagtatatataggtgaagtattccagaatcctttatcagtagcggtttttctgttatatactgtttcacaatcatatatatacatgatgtcagaccatttaggattttccattttcctttctactttctttttattttttgtccaaaggatataatttaaacttaatatttggcataactcatgttctgatattatgtttttttcttggatttcatctatttgactacttaaagcagtacctacaatgcaaatagttttaacagtatcacttatatacatatttaaatctatagaagatctaatattattttcataacctgtattatcttcattaaatttaactgggaattgtttttttatagagaaatacatcttatattcctctatacataattttgattgccgttttaatatcagcaaattcaacttagcaaactttctcatttgctcttgcgttagttctttttctaacataatatttattaaattaaatatttgcttcgtatatgagttattattaataatctttttcactttttcttttttatcatctggaagattcattaactttttatttatatttaacatcattttaatcaccttattccattaaatgaaggcaaatttaaaatcatctttaatatttattaagttatcattatctatattattaattcctttactctcattaataacagctatagctgcatttaatgtagatataatatctatttttttaataatatctatttctttattacctatgatatctttcttaaaattatttatattattataatccatttctattaaatgctttgtaatttgtttatttaagttcatatatataacctgccttccattattctatacttaattattattactttttaagaatttagttatattaacaaaaaaaataagaaactttatttaaaaatttttaaataaagtttcttattaagccatattaaatctctaaaaaggtatgtctccatcatctactggaattatatcatcgtcaaaactgtttccatttccaaaatcttgtcctgattggtaacttgattctgatccattattatatgatgaatctgtggtagctttatctccccactcaagaaatttaacttcttcagctattacttctgttatatatctttttgtaccatctttagcttcatagcttcttgtttgtattctaccactaacccccataagttttcctttgctcatatagttagctgtagattctgcttgctttccccatactactataggaatgaaatccgcttctctctggccatcctttgaaaatcttctatctacagccaaagtgaaattagcaaccgctgttccattccctggagtaaattttaattcaggatctttggttagtctacctattaaaacaactttattcatttttaattacctccgtaaattatatatattatagttgtaatctttttaagaatactttacaatgtcaattactcaccgcctatagaggcgggagcttgtaactctactacacatggtgttaatgatacaaagtatctcccatctcaaacgtaggttacgatacggtgattgacaacaccgcaacatagtgagtttactcactatgttctttggagaattgttcaatatattcaagaccttttctccaaagatttattgatccaattctatcatcattagattgatagttgcaatttttacatttaaagatatgttttttcttatctctattagctttttcaatatgtccacatttggggcatgtttggcttgtatatttaggattaactgaaataactattgagttattcattttagccttatattcaagcagctgcctaaattgatagaaagtccaagatacagaaacatatctattgtttatatttactttttcagtagtatttctaacgttagttaaatcttcaagaacaaataatgtgtttgctccatatttatcaacgagtgcctttgtaatggtatgattaatatcattaacataacggttttctcttgaaccaatagatttaattttacgtcttgctgacttgctaccgcactgttgaagttgttttcttaatattttataatgacctcttttagcttttatatgtctaccattgtagaacgtggttttaccataactatcatagatagttgctagaaaattaataccgaggtcaatacctactattttattaatttcaaaaggtgtagtttgagggtaatctttggtcattggaatatataagaagtatttgttaaacttaaatactaatttagcagtaccaaaactataagaaccatcaaaatatttttccatgcctttagtttcgtaaggtatcttaagtctaccttgtaaactatttatagagaatatatcacttttaatagagtaatctctattccatacaatgtcatattctaaatttttaaaatgcactaaagtaaaatcatgtccattggacttattggttttatatttagcaatagtagtttttatacaactttgagccatttgagattttaaaccatatgtttctcttaaataataataagtatcttcattaatctttttctgattaagacaattattattaaaaatatatttagatatataattcaatgcttttctaatttggaacattgtattatttaaaatatctatttgctcattagtaggatatatttgtattttagatgttatagtaatttctataatatcaactcctttcactattataattattatattagtgaataaaatacaataagaaagtgaggtgtaaagtggcaagctgtggtgttacctatcggcaagtggcaattcctcccccacttatagaagatggaagtatccttgccacgattgaatgaaaattatggccatttaaattagggcataattctttttatatttgtgtaatcccctaatggtgaaatctttactacatctcctgtgtgtggagcatgtatataatacccatttcccatatatatacctacatgagtagctggatatccatgaaaaaatactaaatctcctgcttttgcttgagataatggaacatctatgcctacttgctgttgttcctgagatattctaggcaatgaaataccatatgcattataacaatataaaactaaacctgaacaatcaaagccttgtggagtagtacctccccaaacatatggtacccctaaaaatttagttgctaaattaactacagaattacctatatcatttttactattaactacagatccaatttttaaaaaatcattatattcagcatgattttgttgagctattatactatttgtattgcttgcattattaattttagctttatttaattcttctagcttaacctttagttcctttttcttatcatctatagttttaatatcattctttatagaagaagtattcttttctatctcctttttatcttttgacagtttttcattagtttttattatatcttgtttatccttttctaatgttttaatagtcgtatttccctcttctaacactattttcattattttggctttatttaagaaatcactcatgttttcagaagacaataacaaaactaaagcattgttagaattattatcattttctatataataatctctcatttgagcattcaacatattttctgtttcttttatctcttcttttttattctgtataaatttttcattttgtttaatttcattaattaatttagagtttttgtctttattatcatttaatttgatagttaaattagataaatcattatctaatttctgtatctcaattgttaaatctttctctgctggagctgcattaacaattggatgataaaatcctataatgcttccccctatgatagcactacataatattattttcaatttattctttatcataaagatatctactcctatctatatatttaaattgtattttttagaatttaaattataatcaaaataagaggtgattataattggaagaaatatttaaaattgattatttgttaccatgcgattctagtagttcagaaggatactctaaaagtactactgtagaagatgcaacagacaaattaaagctatatttatcaaataaatataatattgactttgcagatatagctattttatcctgcactccaatagaaataattcaataatacagatgagtaaaatccatctgtattatttcaatctctttatgtcaacttcggcctcttcaatttctaataccaatttcataaattctatattttcttttaactctggggtattgcttgaacatattataaaattatccaagcttgtgcttatattataattaaccaccattagatcattatcattaattcttaaatcatttaaattttcttttaaatggttaagttcactttgaattactttattatcatatattgttgattcagcaatacttatcaaaatagggattatagcattccttttttgatatatattctccagttgtttttgctttttacatttgtggttctctaaatattgcaacaatgtatagattatataaagtgaaaatattatcattaataatactgaatacataaaatcgtcctttctctagtatcataagtgacaatataataattttttataattattaccttgaatagtatattgataaggatattgtcttactcttttattagcatattttttaaagaattttttcgtctttgactttgatttttggtttttgataatcataatttatacctccaatgacattctttatataattatttatccattttaaaagttttggcttttataattctaggaggtaaaattattatttatattacgtgaaatacccttgctataatggctataatacaagataaaaaataatatataacaaaaggacattctttatttttacgtttaaatatataaggatctaaaaccgatagtaaaagacctattaaaatacctatatagctataaggatatataaacaaagtaatagcaggagctaatttaatatctcctccccctattcctatttcatcagtcattaatccatatactaattgcaagatatacataataacaaataaccatattgaattaatcaatatatactttattggtatttttaataatattgctattaagaaagctaaaatatactctattaaacaggtcctatttaatacaattctttcttttatatctctaatagatgccttatataagataatcaaataaatattagtcaatataaataatataatattttttataaccatattttcctctcatctcccttcaatttttacatatgcaaaaaattaaattataaaaacacttttgtttaatttttttaattattgtatatataaaaagctgtaacttataaattaaagggggaacataaaggatgatcagtccaactataacaaaccaattcaataataatattgaaatatgtaaaacactaaaaatactacaaacaataaaagaaaaagatataaatacttataatcatagtgttaatgtagcaaagcttacatatgattattgtgtatattatgatttagataataaaggtaatatttttttatcagcattgttgcacgataccggtaagatttttatagatcctgttatactaaataaaccagggaaattaacaaacatggaattttctaaaatacagcagcatccaattctaggatatgaatttctaaaacaacataatatgggtgaatacatatcgcaagctgcattattgcatcacatatgtgaagacaataaaggaggttatcctaaatttaatatagcaaaaccagattatatacgtttaattagcatatgtgattcttttgaggtaatgacttgtaataatagactctatcaaaatagaattagtacattaaaagctttagaagaaatagaaaataatataggaattcaatttaatagtagaatcgcaaataagtttatagattggatcaaagacacacaataatattatttaaagttattgtggactactcattctatctaaaggagtaaggctttcgtgtgtatttcttataatataaaaagggcaataacacttatgattaaagacataagtgttattgcccttttactcttattgtatattaattttttgtacttctatattattttctcttaatgttttaataaaacctgcatttaaagctttaataccattaatcaaaattttcctgtcattatcatttaatggtattatattaacaatatcattattgtaagatatttgtgaagatttcaatccatttcctatatctacaatatagtcctttggagattgtaataatgtattaataacatattgctttgattgttcaaatatattattaatattattgtcattattcatatctgaacaattattagctgctactggattagtattagcagatttgagaacttttcttataatatcattaattttttcttcctctgttttatattgtattatttctattaccgctacttctagtaaagttaaattattataagtatatttactatcattaattttttcttgtaatagctcaatatacttaattaaattttctttattaacttgttttcctaagttaatcataacctgtttttcctcttctatagtggctatttcagtattagggtttatagctaatactaaaacatttctaaaatatttctgcagatctttcattaattgatttgcatcttttttattctcattcacagctttatttataagctgtaatgcagatatagtatctttcttaataatgctaaaagctatatttcttatatcttcttctatcattattgctagtaatgtagtaacattactataagtaatctcttccatagttctaacctgatctaaaatacttatagcatctctcatagctccatcagctactatagaaatcaactttaagcttttattatctattttaattttttcatgttcacaaatatatttcaacctattaaatatatttgcaacatctattcttttaaaatcaaatctttgacatctagataatatagtaataggcaacttctgtggatcagtagttgctaatataaatattacattcttaggtggttcttctaatacttttaaaaatgcgtttacagcacttatggacagcatatgaacttcatcgattataaatactctgtatttacattctgatggagcatattgggcctgttctataatattccttatatcttctattccattatgcgaagcagcatctaactctacaatatctatacaattacctgcatctattttctttgataattcattatctagtggttctccatttttatcatgctgatttacagcttttgcgaaaattctagcagttgttgtcttaccgctccctctgtttccacaaaataaataagcatgacctatatgtccagttcttacttgatttaataaaattttggtattttctccttgacctactacatatttaaaaattcttggtctgtactttaaatataacatcttgaaattcctccctaattttagctctacattaagccatatattctatttaaataattattatttcaaaattttaaaataccttaacagcacttagtactgttaaggtatttttttttagatataggtataatatcttttttattgcaacgcaattgtcttgatagcatatctatatatagtaattttataacttcataatttgaatttgaatatataacatttttatattcaaatttaacatatattgttttatttaaagaaggcaaattatgaattttaaagtaaaaattattcaacaatgtcaactcctctaagcaacagttattgtaattgaactattattttttatttcctgtttgcaattatcacaaataacaatctcatcaattacattattattttttatttctatttttttattgcaaatgacgcatatattatttttacctttcaagattaattcaccttcctgctttctttaatattttcattattaaccgctcctaattacagaacagcttaaaacttaattcttctaatactatattaggattagaagaaaacttaattctagtttcatttcccataaatgcaattagacttttgtctaactcttcttttgtaaaattgctagctgattcataaattagtttacagtaataaggatttttacctgtaaacttaacaaaactatctaaactatgattgtttacttgaaacaatctagcttcttgtaacatttttatatgatttaacaatgtataaaatacactaacaggtttttcacctttatctaataagttcttaagtgtattaaagtaaccattgacatctttcttactaatagaatctgttaaatcaaaaatatcatcatcattataagaagatatacagtttattatatcttctatatctaatgtatttttatttaaacataatagcttctttatttcttgtaaagctatatccatatttaaagtcttattaacaaatagatctaacgcttcatttgtaatagcagtattgtgtctagcaaaaatactattgcaaactttttttacataatcagattgaaactctccatttataatgaagaaatcatttttaataaatttctttatttctgagtttttattaatatttgttcttttatcttttatatatgaatataaaaaaacactagtttcatctggaatactcttcaaggctttcagcaagccatttattttttttgccacccctgttttaaataaaggaagttccattaagataactctcttactatccataaatggaattgtatttattatttttttaaactcattttcctcttcaatcattttaaaatccattttattaatatttaattttggatttataatttgtgaacatagtagttttttagttttattaaaagctgttacattatcagtaataagtaaaatcttattactgtttattgttttaatatttgttatattttccattttatttcccccaataatttataaactttctactaattttatataacgattttttaaaatttcatttcttgctataacatctaaatagttattacagcccttactttcttttaatttatataaatcaattttttcttcctcagctagctgcttataaaccttttgtcttaaagagctatatctaatattatatttttgagccattctacttattttctcattagtaatttctctccataattcttttttatatgaatcatgagtctttttattttcccattttttttgatagtatggtactaatattaaattagcatcttttacacttagccctaatttttttgatataaatataaatcctgttgctgaaattaacacgtcatcttcttctaatttattaccattaggtaggtccttaatatagttatcaattattagatagctatttacagggccttcttttattaaagatactacttctctattatctaattgtatattgcaatgtttttttaacaacttagttattcctatcccattaatatacttttgttcatttctttttaaacatataatcattgtgactcctccttttattcttttagctttaagccataacaaagcttctttagaattattattccaaaataaaaaaagttgcggttattcccataaccacaactttatatatacttttttattaaaatttattagcttattctctctacattattaaaatctttatttactaataatctatagtttttaaaaaatctgcctaaattatttcttatcagcttttcattttcttcccaggtatatcccaagggagataataagcattcatttcctaagaacaaatcagcttcataattagaagccagttgatatgctgttagcacatcactcttaaatttaaatggtttctcatatgctttaattaatgcaaaagcatatctttctttaaaaaatttatgcattattctatctaataaagtattagtacctttttttactttatacttatatatatttttgcatttaatattgatatatttcagtagcggcatttcccactgtatatcaacatttttaagactatctaaatagccttttttgttatagcttataattaatttacctaaatagatatttataatatcagatttgcagctaaattctttttcacatttatataaacctaatcctgatattgaaaattgtagtccttcatattgtcctataaataatagaatcttttttcctattactatttcctttacttccattccaaaatctttccactttaatattttcatatagcatcctcctcaattttagctaaaagccattattactaactaaataattattattactttatatttttttatttgatttatataatatagagcccacaacaaaaaagagcactgatttcttaactatcagtactctttttgttaaataactgtatcatctttttaatatcatttatgaaaatttcatttttccttctcttaatgttattggatttaatgtaattatagttttattttgctttttagcatattgtatgcaattataagttccacccttacaatttccattgtatatagctataacataattagaacaatcaaccatatatctatttcttacttgcaattttcttatattataggtatctttctctattttggatattttatatctatctagagcatccacataaactaattcatctgctaagttaagcattcttctgtatctttctctatctatatcgttccacttattaggttggtttttaaaaggtatcgctagtatattctttatgtatggataccggatctttaaattttccactacaaaaaatgcaactgtatctcctccaagagctccccctgtaataaatgtatctacactatatctttctattagcataatacatatttctctaatctttttagctaataattgatacttcttattgcttagctcataaccatataataaatgaggcctatgagctgtaaaacatactaccattattacaaagccatcctttctttgtataaagaatgctaagttaattaacttagcatttacctatgtttatacttttatatctttggaaattcctccatacgttatttattttgtcttaaaaaacatatttatttcattttcttctttgttcttattgccaaaatatggtcagtcattcctattacagaagcttccaaggttatagtacagctaatcacttgagatgatttagaaactttagctaagagtattactgatgctacaaaaacaaatgaccaacacaaaatcattacaatatgtttattaaatctcaaagacatattataccttcttccctaattttaatataaacacatattaaaattctccatatttaaactactataaatactatctaattatttacactatatttcttgaatttcgtatcttaattaaaaatactttttaattcatctatgctttttgtagaaaatatagatataacctcatactgccaatcatattgaggcttttcattatttgttgttgtgtaatctaacatgatctcatgtacttgattccacctcatacgcattaattctggtgaggtaagattaatactatttttaatgtttaataattcattattaaaatccttattttctgatattctaatcatttcttctataacattttctaactttctcatcctttattcctcctaatcggttaataaaaactacattttaagtacaatattatttgaaatacgtattaaaacgtattagaatttttcactataattttattttttcgtcttttatatattgtgccatataatataatcctgaattaaaaattacctcaatcttttctacatatttcaatggtactttcatttcctctccatcaccaagaaccgatttagtaagaacaagttcatcatttgcaatgctttttacaaagccttcaacacattcattcattttaataattttaactttatcattttcaaatacataagttttatcatccacaataatatatcttttgatttccatttttttcacctcaattttgattaagtcgcactatatttgtaaagacgaactatttaatatcttctaaatcatcaataaatctttttaacatttctatttctgcttttaaaacagagtattctatctctctctttgaacttttaaagccttcacaactgtttttttcctcaacatattcaacaattcttctttccttcaattcaagtttacctttataaaattttaatacctctttcatataaccctccataatttagttcataataatttcagatcctgcaactgctttttggattatgacctattttaataatttggcaagttcacaatcttttttatacccttgtatatttggatttctataccattatcacaaagttatccttttttttataagaaatgctaagttaattaacttagcatttagtttaatcatcaaagcctttagtaaattcttcttctgtacatattttatactctaagaactctcctttgtaattccaccatccctctattttttcattccaaattatccttaacgctttaatataatcttttttttcatttattgcaggatatacatcacattgtaaaatttgaataccttttgctaataattgtgttctctgaatagacatttgatttaaatccccatttaataaatacattctttatcctccttaaattaaattcgtaataattcagctcatgtagccgcatctttgtattgcgcaattagctaatcaaataaaatataatcaagatcttcatcttctatatttctaatcatttctctaaaattacaaggtgcatctccatcaacatatctataaactacttcaaaaggtcttgaccatcctccacctttataaagctttgaaaaatttcttgattttacgtaatcttttactttgttgtcccagtcataaaacttattttttttgtagaaaaaagttatcgaattttttatttgattaatatatccactttcttcatgactcattttttttaatagttcttctgtaaaatctattatttcaaaattatttttattttcaaatttacatttaaccaacattttttcaacctccaaatttaattcgcaattatttcatattaaacaagtataatggcatagccttatacttaaatattataatattttcttaatctttccaactcatctttgctatatctatgagaaaaatctatttttttatttttgaatatacttactaaccataatccaacatctattggatctggattttttattaaatctgttgaatatggtatattataatatttttctttatttaatatatcaatattaaattctcctccattatcattaatgcaatagtatatcctgtctatctcggctataatatattcctttctgtcatttataacatctacagaacaatgttttttcactactgctagcatttcttcacaatagttttcattatatattccccatacccttccatttcttaatttcataatttttcttcactccctatttatttttagcctttaaaagccataatttttattctaattaattattattgcgaaataaaaaaatcagatataaaaatacctgatttaatattctaagtccattctgtccaataagtatcagtttctccaccactatataatttattaaattcttctaatgtcatttctgactttaaacaatcatcattacagaaatactgtactccactatctatacaatatccctctgtcataactcttccgcaattagaacatattcttgtttctatttcttgctgctctaacaattcctgaaatttctttttattttctttatccaaaactatattagccaatcttacaaattcttttattgtagttgtattcatactttttcctcctaatcttagcttttatacgccataacttattatttgattaattattattacttttaaaaaatttattataatttgtccttgtaatatcttaaggtatatattagtataatatataaggagttgtaaatttttaaatttataacttttccttaaattttagcttaaagccataagaaagagtattaattaatactctttcttttttatattatacatatttctattgttaataaaattacttaattgggaatccaatcttttaagctctttaataacagtatttaattcatttttatatttctcttttttctcaacttgtttaaaatttttatattttgtatatataataaatatcacatcccccatcaaatgaaaaataaggtaccatatataattatttacatatagtaccttatttttatttgctttttctaacatctattttaatttttgtcataatgttttgtacatcttctttattcaaatcttttcttttaatcgcttcttgaaaaatatcgcttatagcatcccaatcacatattatatcttgttccaataagttttgtatttgttttgttctctctttatcttcactccaaaatttaaagtcagatagaaaatcatgaacatattctcttaattctataatagctgcagcaacagcatcttcttcagtgggtttattaacaataatatcaaagtctttaagaaacacagttacactcttatcattttctatatgtttatcatatcttattcctttataaatcaaattagcacctctattttctctattttataattctaaaatgcttcactctattactttttgcctttaatactgtatctgtattattaggtgaatgctcattttcatttaaatctgtattaagagtataagtttctattccatttttacagaaaaattctttcattaatgatggttcaccattcaacttacgcaaattatttagactttccatactattcataacaaactcaaatatatcatcattagtatatgcccataaaaaatctaaaatattttcattaccaataggatcattttgattcaatttatttatataatcttttgtgtaaaaataatcttttgcacaaaatttatgtccgttaaagtctttttttataggaaacaagttaacaaattccctcggtgttaataaggccatcatatcatttaatacaaatattaaattaaaattatctatttctttttctttcctcactgcagttggctcttcagtattaacacttttaactccataaaaaattactttttttaatagataagtcttatcttcataatgtttaggatcttttcttaaagtatcagcatattcttttaaagcattgtaaaaggcattataatatattagatttaattcattattaggcttttttatcatcttaaatttactcccctcaatgtactaatagttctataatttttctaaaaaagatatactaatatattaatttaaaaagatccttttacaacaaaaataacaaatacataattaattgtaggtatctactttattatctaaaattactttattgtttaaaaattttatttcttgtatatataataaatgtagcaattaaaattaaatatttattccccctatatttaatttatccatccatacaaaaggggcttgcgactaaaattatgtagtcacaagtcccttattttaatataatttctatatatgatatctgaaattatagttaaacctataatttatattttttaccatgacaatcataaaaattcttttttctcccacaaaaacaagtatttaatctcttattggattttcttcgcaatttatataattcaattttttcaagtatatttttcacatgttcattttcatttatttttccttcactgattgctatttttatattttcctttataccgggataccatatgtctggttttactaaataaattcctatcatataagattcaaatgctttgtcataatttccttttattaaatatacaagacccatagtaaaatgtgcaaccgaatcgtatttaatatttatagattcttcacacatttccaatgcttttttgtaatcacccttaatgtaatatgcaaatgctaagttatctagattttcatcctttcttaattccattaagggtatagattctataaacttttcttcagtcaataatttttttagcgcaatacgatcttctatctcattatcaactatcttaaaagtaaaagttatctcttgtttttcataccaaaatccattcttctttttatttatctctatttcaaattttcctgttggatatgaacctgtgcaattcaatatctcattaagtgctttatcaattggatgctcttcatttctaaatatattaattattttatcacaataatcatacatcttatcattaaataagaacttttgtatatatatcccatgttccctctcatatacattttttataatatctttactttctttattattaggccttattttaataaaatctaaatttataaaataagggaaaacacctaagcatgtactaagtaaaatattctcttcttcatcttttaatagtaaagttaattttgtttgctcttttggtgtactctctcgaaattttttcaaaaatccctcacaaatatctttatcatttatatctcttcctattttttttatcttatcttgcatatctttggaaataagacatggaatttcatcagttccaactaatgctgtatttaaaatgtctttgaaattttcttcatatttaatatgctcaaaatttattctatctggaactattgtaacaacattagaagtcatcaatccatgaattcgcaatcttcttaatccccgattactccatatattcatcatattattaaaagaaatattatctgatattctttctgaaaaattactatctatgttaagagttattttacctttactggatatctccatatgtaaattaaatggatatttatctacatcttcagacttatttgtaaataaatatatatctaattctcttctcttaacatttatttcaaagttaaataacatgtatatatctttttcatcataatttatatttggtattatccttaatgaattaatcacacctgattcgtttccaaagctattattaaattctatatcaggatcaggtaatttaatatcctttaattttatatttctactaagctctacagggacgccagccatgcttgcagcagccattatagttccgaaatctgtcatatctaattgtttttctttttttactgtagttattttaaaagttcctatagagttatctacattatcactttcttccttataaaactcttttaattgtttttttttacttttgacatgctttccataagtttaaaaaagtttaaagagttttcactcaatgaacgctcaatagattggactgcataaaaagtatcttctgttaattcatttggatatttaagaacatcaatggaaaaagcatgtagcaacccataatctaacgttactctacgatcagcacttccaaattcatatggagtatttctttcatccataaaatactttagactagttgggaaatgtgttaggacttcaattctatcatctttatcaccctcatcatataatacaccaaaattctcattcacatatatcataaagtgctcatttaaacatgcgtttacatacacagattttgtgaattctaactctaaatgacttcctataaataactttataagttctttaaatgaatctatatttctatttatgatatatacacatttttctctctcatagattatatattttcgagattgtaattcactaataacagcatcaacatctctttcttctcttttatttgaaaaatactcataaatcattgcttctgtaacactatcattttgtgccataaaaattaacaattcttcttttataacttgagatacatcaatatttatgtttatatcatctatattaatatcattatcctttaagatttgcttcacttgcaaatgtttgtttaatatttcctcatacatttcatttattgcattttctaattcgtaattgtatgcaactgcctttatattaatagaattattatatctattaataccagtcatcacttcatgtctttcgtgatgaattaaactttcattacttattcctaaaaactcttttactaaatatggtgctctttcttctaaaaaatctaattcatcagctaacctaattaatgcagataacaatttaattcttatattccctccttgtccatatgcctcacattcgtcgagtgaattcaaagggactaccctatgactagaagctattctttttattgcattagcttctttcgtatctaaacctaaatctctcttaaattcatcaatgaaatctcctgatctatagttgtgagaacttcgaactttttctccatatccagcatcatctataaacctactattaccaaccattcctatatcatgaactaatgtagctacaataagtaaaaacttttcatcatcatttagaatactaagagtttcattaaaacagataccatacaaactttctacacttaaagaatgctcaagtgtatgctcagtaaatgtaggatttacatttgttgttcttgctaacaacggccttaccatattttgtatagtttcaattcttaacctatattcttctgataatgaatccctaagtaaatatttttttctattttccattaacagctctccttttatttcaaaatactattgaagttctctataacatatttttattttataaccatattttatcatatagttcatataaataaaaaaatatgcttaatattttaatgaagtacattttatttctaaaaacttatataacgtctacataaaaaagcgttatttctaaaattactttattgtttaaaaattttatttcttgtatatataataaatgtagaaattaaaattaaatatttatttcccctatatttaattttaatacttcacattccccctccacatataaagggacttgcaactaaaatacatatagctgcaggtccctaatcattattctattattgtttttatactttttaatacttcagttattggcatattagtatctattacataatcacacggtattatttgaaaattttctttatcgtgtattattctttcttgtgcctttcgttctgctattaaatagttcttagacgtatttccatttacatcaatatatctttttatcattctacctcttctaatttgctcatctgctcttaaatataatactaatatttttgcatcatctatttctgatcttaattcattaactcccttaacttctactatatatatagatgttcccttatttttatattgctctttagtagcatagtagtgctcatctttatagcaagcatacgctattacattttctttaggataataaccatcatctaatatatcaatatcattcctatcatttatactatttaaaaatatgtgtcctctctcacctttatatcgtggtttcctagttgtatagctttctatataattatatccttccttctccaataactctgctatagtagatttaccggacccagattcccctactaaacaaataattatatctgtattgttatcttgcattatataattcctccttaagcttatacctttgaataaattaactttctcgaatttttatctaatctttttttaaatctatttatatttctttcattaccttgtaattctatagttaatttataattaaaccaactatatttttttataattatatttttaatacttacattataacttccattggctataattaaactacttttaaattgctctaattcttcttttttaccaataatgttcaaaatcaaatatcttccctcctatatttttcatcatttttagttcttaccatatacttttttaaaattattatttcaaaaataaaagaatcacacttaaataaatgttttcatgcaaaagagacaatttacattaataatactgaagcatttaagattcaatcgacttatattaataataagagcttagagattatattaatcaaaatgtttaatatacaaaaaactaggtatccttatatagattaaagaacctagttttagatattattttgattgtgacattaattatttgtattatagataataacttctttatgcaaacaacatttccgacatttatttataagaaaataaagcgatgcagttaactacaccactttatttttattattattttaaatatataagatcagatatttctttaaattttacagtcatagttgactgttctaattctctttctgaattttttaatatattttttagcattcatatttaatctacttttttaaatttcctcccaaacttttaatgcctgtgcttctgtcatctccactcctctaggacttccgcaagcttgtgggtgtccatcaaattttatgcctgctatagttttacctgcaaacataaattttgatcttggatttgcatatattgttattgtcttatagtgctgcctatatacaactacaatatcataattatcttcataagctcttgaaggatttagattattctgagcattaatggaaaataatattttattttcttttttacttcttacacaatctatataagccttctctgaactttcttgtactttttctcctatttttattattttttctgttgaatactttaatatttcttctataatattagtaacatccactctctcctctgatactctaggaatttttaaatccctttgtaacctacctatacctagttgatataataatgctttgttatatttatctctacatatactagaaccattattatctatttgttctaacatttctaaatctatattaggcaagtctttacctaataatcttaatattcctacatatgtatctgcatccatatgtgtaatttctatagttgaattttcttctgctacaggtatttgattattattacaagggcttggataatgttcaaattgaccatgatgatcaaaatgtttcacattgtctcccttgcctgcttctattgaatatccttgaaattctggtttacttgttaatattattttcattttaattcctcctaattttagctttttaaagcctttattttttatttatactttatttagcataatgccatataaactttatatatttattattacaaaaaatagtaatcgtactaatttctcatttttataattaagaaattataaaaaaactagaatttttatccttataacattactgttttgctacaactaataatattaagaatacaacttctaatattattgaactaatcataatttcatttattagtttttcttctaattttttattgcttaatttacttttgttgcccatattattttaatcactcctataattttagcttttaataaaccgttaatatattatttgattaattattattacttttacgataaaaatttcttgtttaaaaattttatttcttgtatatataataaatgtatattcctccattttctaattataaagaaggtgttatatcatttcgcagatatagcaccttctttataaattctattttattttttaattaagcagctaatgatacagtatcatcattacttttaataaactcattcggataggaatttattagcatatttaatattgtctgaaacacaattatactgtttttttataataacattttctatttttccataaacattcatttctttaaacatactataataatcacctttaaagcgactatctcctatcagcagtgccattcttccacctttctttaatgctaaatagcttttatatagtactgtattgaaccatttattaaattgatttttatcatgcatatgggagccgtcatcaatatgagctacatttccccattgctttccactatatattggcattttagaacccttaaaaacatagtatggtggatgtacaaacataaactcaaatgatttggggaattcatcctttattatattgaacccaccaaacttaggatttaaatccattcctaagcactttatatttaagtcctttgctacatctaaagatgttccactacctagcataggatcacaaaattcttttacattataatgtaaaagaatatcttttattagaagtccactgcagttacctctccagctattactaccatatttacctctggcaaaatactcagctatacttgttaatcctccaacctttttgaaagatattctttcttgtgttaaatctcctataaatttatctcccattttattttctaatataacttctttttttcttccataatctttaatatcaatatttattatatcctttgttaaatatgaatataatttttctaatacctttccttctaacataattaatccgccttaaattttagccataatttagccataaattattgattttaattaattattatttcatcaattctaaattatatatattaaaaaagcataaaggtaataaaatctttatgctttaattctttcgttttgacttattatagtataaaattccttttttattaattcattaggaattttgtttgggccttcatattcgtgatactcctttagtatattcaatattaaagatccatatatataatctaaagtttcttttttgaatcttctggccttatttgtttgattattaataatcaaatcatcaataccttttccatatttctcattccactgtaagtaaattattttatactcatggaaccttttttctatggcatctgacatcttttttccttgtgtatatacttgaaaattaccaatcatatcagcatcaaagcaaatatatattggtatctttttgttttttattcctttatactggcaatataaatggaacttatttattgcttctttatattgctgcaatctttttatttctcctattacttctattatttttctccatgttgttactccttgtacactaattgctattactcctctttctgctaatttttcagctttaaatctcccttctgttattgctaaggtaggattattagttatttggctaggatatactacatctattggacttcctgctcctgttcccaatttgtatttatctttgttttcctctaaatttgcaaaggaagaagaaaaccaaatgtatctttgatcctgtttattcctctttttatcttttctaatttgaatacctactatttctcctttagtatttcttatttttatacctattcctttatattgtgcaaaagtatattggttcctttttatatcaaaataaaatcctggtatattttttaatattttttcattatatccacatttatttaacttatcaacgaattgattccatatctttcttgtagggaatgtaaaataatctctattaatacgctgcggagcaatttgtctttttgttagtaaatgaatataatgtgcactatatatatcacagcagcttgtaaatatttcatatactttatttaaagtatatgaatttgctttaatgctcttctcattattagtttttaccatatattttttttgtatatttttaatttcttttgctttatactttcttttagaaaaatattgttcatattctacactgctaataagattaaattctaatcctatattaaatgcagcttctacataatttactttatcatgcagtgatataaattgaattgcatctccacctacattgcaagtaaagcatttccatattcctttagatggagttactataaaactaccaattttatgatcattatgaaaaggacatattcccatataatacataccttttcttattagttgtattctagttcctataataatttctaaagatatagactttattttttctattaattcttcaagaaattgttttttattcatattgatttccccctaatatttatctatttaaatatttcttattccatttaaattttttagctataattggccatataattcattcaattagttattatttcaaaactagaatctttgataattttatatttaaatagatttattaggttattagttattgatataattctatatatttacaatatttctattgacaaatcgacctgaatgttatatatttataacataagataaaaatatataacatttgttaaaattatataacaaggagtggtacttatgaaaaatatattaactttaaaagaacaatcaatactaaataaaggtctaattggagttatatttattattatgggtatattacaattgtttagaattaacccaatattaaaattgatattaggtgttattgcactaattggattatttttatcttgtcttcctgtttttataaaaacagaatcagaagatgaaatggctgaatataacaaaaatagagctagcgcaactatatatacagtattgttaatagtattcacaatctgcgtattaatctctactcatacagatcaatggacaattaatttaaaaataatatcaccatttttattaggtggatttaatttatctgaatgcattttattttgtatttatgaaaaggtcggtgattagcatgcccaagttaaagaccaaaattcatgaactacgtaaagaatttaacttaaaacaagaagatttagctaaattagtgaatgtaagaagggaaactataggtaatttagaaaatggacgctacaatccatctttaaaattaggaatggatatcgccaaagtttttgacaaatcagtagaagaaatatttgaatttatagaagatgatgaataaaataaaaaatcaaaaacaacaacaaaatccatttaaagctctttcctgaaagtaaatcaacctaatcaatttttagctatatatcattcattcaattaactattattttaagaaaacaaaaagtgataattagatatttgatacctaactatcactttcatattttttattatttaattttattatttggaatttatatataatttctcattatctcagtgattttatctagatcttctcttttaatagcattccatgtgaattttttaagtttatcaattaaattatcataatatttatcttttttatatttttctatatctaagattataaaagaagattcacctgctccattcacttctcttaaggtattcttaaaaaatctcttttttttgcatgcctcaactgtaatatatcttctacctactgcttctattattgtttcttcaattttcgatgttctcccttgatatatacatacccaaactttttgaccttttcttatctccatagtctaataaccttcctttataataacttcaactcctgcagctgctatttgaaatacaaagcaaacaaaagcaattactttctctgatttctacaccctttctataaggtaaacctgtctttctaactgttcaaacatttatttcttttctgctttgtataatactatacaccttccttataacatatttaattgctcacagtatctgtgattatcctcctatgtttcataatgatttcagaatatatttgtattgtgaatcaatttaaaatgatatctccccaatactgaaatataactccttgtaattgtgctgaaatttcttttaacttatcccattgggatttattaaatttttgaagatattctctatttttattttgctctgcaagaaaattctgtaggttcaatacttttgcatattctaatttatttaaggtttttggttgtttagataaatcaaagaatccttcatgtactttatattctttaattattttattaacttccttatctgtcatacagtcctccttatcgcattaatttcaggtgcagtccctggtcctgtgactgcttctttgtaatgcgactataattcctcataaactttttgacttactgactttccgagaacatactctaccccttgttgtgtaagccaaaaccatgttaagccattatcagcaatattattactcattgtagctaatccttttttcactaaatcattccaatcttcatctttggattgtgtttcatatctatttctataaggttttttcttataatctaatcctatacaatgtttaattattctatcttgatattcagtagtttttatgaataaatttttatataatcttttgaatgtttcttcctttgcttttgtaccaatcatagggtatctaccttgtatatactcaataccagcatggtcaatactttcgcttggtgcttcaaaaaaacttgtgttttcttttgttccaatgtaaagcgtaatgtaatatcctccatgtttgccattgctcttttccaatctcaatttattcactccttaataataatttcaattagcacttttcaattttttcaaattctattacccatacccatggattagaattccaaccatacatgtcaatatcttttttatttactgtactatcccataaatctttaaagacactagtccagccatcatatccagcttttattccttctctaattgcttcttcataatctaatgcttgtaatttttctgctcttacacctacaacctttaaaaatatccttgctgcagttttaggcataaataaagaaggttgccatccgtttttacaaaaatatttaattaaatcctcatatctttcagatgttaaggaaacttcatttaattctttattaggttcagctttataaagaaattttacttttttatcaaaattcttcatactttgaatcatccatgtttctctaacatagagaatatccccaatttcataaggttcctttatttcttccattgctcttaatttatggcttgtagtaccatccggattttttataggttcttctacgtcattttgcatgtatacaagtcttgtaccatatttatttctgaaccactgtatatctgcattttcatatttgttttttataattcttctagtttgtgtctttctaccttctaaaattgcctgtaccatttctgtattaaaaagtataggtttttccaatttaattcccccttctctacttcacaataatttcaaattgtacactttttttgtattatgaaatatctatttagttgattaattaatcttcctcttgaaaattatcaaagatctgttcttctaactcaatacatttaacaccaacaggataacttcctatgatttcttttatctcgtttcttgtcctctcttgaataaatatatcatcacaaatcttacatttttctacagtagcattactgactttatattctttattttcaaaaatgatatttatatttttacttattatttctgtatttccaccgaaatgacatattgaaatttcttctttcattgcatcttcaatcaatacaaaagccaaaaattattcctataatatattcttctttcatagctaaaaatccctttcttttaaaatattaaatatatctgtaataaattattttaattgtacaatattttttattccaattggttcatatagttcataccattttttttcatctttaattttttgagtataaaatataactttatattcttttccttttgttcgcactattccacgagattcatcttcaagatttatatacataaattttttatttattcctaactctttttctatcaaattttctgccttttcaaaatttttattttctatttgcaattttttattatagtaattaattccaaataatatactcataattataacaattccaattactatgtgaggtatatattcaaatatcaatctatatttcttaaatttattgccattcatattatttcctcccacccagtaaataacttaaatatttaatgtgctttaataacctgttatctcaatcatacaatacccttccttccatataatagtttgtacactttcttcttcggaatgatttatttctatttcaaaaggttcttttctagtattatattttatccaaatttaaaaatattccataatatttttaaatatattattatttatcttctttcttcttatatattgtaaaatttaaaataccatataaaaatttatataccttataacctataactaataagaactttataaatataggatatatataaaatactggtaatataattcctaataaaatatgccatacttttagtccatgattttttatatgttttaggaaatcattataaatagattcttcatccaataataaacatggcgaaataataataaaacaaactaaagtcataatattaattgctaaatataaattttgggctatttgtagtttattcataaattaatcatgtcctttcttttaaaattgtactaaagaatataattcatctttagcgtcttgatctatgcctatatatttcaaagttatttttctgaggaataattaaatgtattcataattaatcctatattataacgtgaagctttatatgtgcaatagccccaagttttccttaacgaatgggttccaaagttctctatacctaaactttcggctccttcttttaaaatcctataagcttgtgtagtgcttataggactattaattccttttctactttgaaaaatataattattctgttctaatttattttgctttcatattcttctatatgcaaaaacaccacataatctactgaatagcccggtgttttaagtactattctttatttaattttccaggaactctttccatagaagatttagcaattatataattttcgacctgtttttctgtattcataaggataaaatttatcatttgctatggcttttcttaatgtactatagtctagtccctaaatggtatatctaatgcatctttataactccatttatcagctaattccattcttgttaaattgataatataattactatcttcaattaatccatcacattctaaaatctgccaaggtgtttgagcttttaccaattgagttgctccacctttaaaaacaactaaccatacaaatttactttttgccatcttatcaattcctttctttacaatgattttatttctggatctaatttttgaattgcgtaactatagatttacaacattagcaatataaagatactgtataccctccttaattacatattattattctgtccatactgcactcttacaatctattgcatcagattgactaccagttttaggattataaagttgaggtattgcttctccatttttttctacccaaaaatctatttcatgtatttttatatttttattatcattcttgtgatactcctcatattcttttgtattaacaaaatccatcatccatccttctttatctccatagggaatttcaaatatattatagttttgaatagggaaatgctctgcaacacatcttttcaccacttttttcaacatttcttttgccaacatttcctctttatattcatacaaatcatcagcatcaataatctcatgcttttttattgtactattttcttcccagtatgtaggatatcccttatgcatatattcccatgaaatacttttgcaaatttgaataatatttttttcctttttcttcttaatccttttattcatcttttctcacctttcttatcctattcattactatttgagttttctattttcgaataactacaattaggacacctgtaaacacgagtgcttgatacaacgagtaaaaataccttatcatatactaaaagccccaaccctaataccataattaatatacatatagctgctaaataatcttccatacatctctctcctttaaattgaatcttagtacaataacctcttatttctgtattctctaccttattagtactaatttctttatttctgttatctcataatgtgtaaatcttacttctctatgtttatatttagcaggtaatttatatgtcttagttactccgactgaaccaaaaactgccatgtattctctaccatttaccactacttttgaactgtaatcatcctcatcaattccctcgtagctaacttcatcatttatataaatactattacgacttatacctaattttttctctataagttcatattcctttagtagccttttcttctttgcatcttcatgaacattgtcagtaacattacgttcagctgattctagttcgtcttgttgttgctgaatttctttatttttcatatactgcttatattggtatttaccgcattttactataccagctatcatgccaaatattacaattagaccaatgattgccattactttatcaccagtggttattttttcattttccataacatcactcctaaactatgttattgatacaataaacccttaagatgaattataagtattgtatctatagtttttttaattgtaacttaattaaaatatcttattacctgttctccaacccactttcccattggaacagcaacagcattacctacttgtttataaatatccctgttactacctgcaaatttaaaactatctggaaatccttgaagccttgcgtattcttttggcgtataaggtcttacccttttaccatcattaataagtcttgtacttaaatctttactataatgagcaacacatgttggtgctactccttctggtgtagatattataggtttatccctatatgctccgttgagccttttataaacataattaggtatatctatttccggatcatcttctaataaattttttagctttattggattgctttctggatattttaagttatcaaatggccttttagtgccaattaaaattaatctttttcttttttgtgggagccacatattagcatttataggacattcaatccttacataataatctggtaatcttgtaagagcttccattactactctaaattttttcatacctggaacattttctacaatgtacatttctggtcttgctagtgccacatgcctaaaaaagtgtaaaaataaatcatcaccagttctagtaccatgtatatctgctatagctgagtatctagtacatgggaaagttccaacatatatatctgcatcctgttggtctaatactgtaattttacttatatcttcttgatgtatttcatgagtaaaattagttcttaatgtattacaacaagtagaatctatctcataagaatgtgttatatttatacctgcttggactaatcctaaatccattcccccagctccactaaaatagcttttagctgttatcatttcatcacctcttttttatatctcgtatacattcctctacgaatttcttatattctttatctactgcatttattagcaatttaactatataactaataatttttactctttctctactgcatctgctatctatattatgtgatactaataacttaatccttattggcaatctttacaataacatccatgtgtattacattctgcaacatcctctgatgtatttttatataaagcatattaacaatttaagcatctttttataaatgcacattcattacaatctagtttaattattttctgatcatcgtcatcattttataataataatgaaaaaacattattccaagtacaatcattgaaataataaatcttccccactttcatttttatttaatataaaattattttagttcctggatccggtagttgtattgtaaattaaaccattctttcttctgacgttttatatacttgttttatttctgatttaggtatttttacataggattttctaaataacattttttcctcttcaccttctggctcataaatatcgaagtttttaccttcgacttttcgcttatgcatagtgtaaaaatcacctttatcagcataaccttctaatggattttcatttctatcatcccaactatggtcaaattcaactatttctccatcattgaattccatataccatttatggagtgtatgtttaaattttcttatttcacattgaattaaagagttataagccttaaaatattcttctgtatagccataatacaatctacaaaggctatcacaatatctaatccacatttcattatcaccaaaattaggcatccaatattcttcaacatttggattaaaccctggaacttcaccatcaatagaatattttaaatacatttttaaaatatatcttgatttatctgcacaacatgctgaaccttctcttaattcacataaatttcttatatgattttctaaaaaactataatttgcataaataaaattaggtttatttttatctttacaaatagatggttcgtgcaatgtacttgctaatagttttataccttttttcaacttatgatttataaagcagtcaaaatattcaggattgtttatatcaactttactttcttttgcatgattaatcgcatcaccaaacattttcattgcctcttcttctgattttgcattcaatgcattaaataaacttgtaagacatttagtcatttcattattcataataccactccttaaatctttttcgccctgtttaagaattccgtcttcattatttcattcctggatctaattttaaaattatggactaacttgctaatgtatcacaccatctacaaaatgcttttaatataagcgctacattagcatcactaaattctcctccaaatccaataaatccagtttggctaaatgtaatgccttctctgtcatcaaaatagctgcccttaattcttaatcgtgcatattttaagccactttttttaagtacttttacatctttaactctttgttttcttacttccatacccatctgttgagcatgaaaacctccattttctaaataataatttaattcctcagataaaatttcagttagcctttcaatatcttccttcttgatcttgctataatccaatcccttatttttaaagtattcccttgcttcttcacgctccatttataaagactcccttcgtacaaatttcattcctggatctgttctttgaattgcgtagtattttaaatataaaaaaataccgcatatcatcttaaataatgcgatattttaaatacctattcatttttatttacactaaacacataactcagtctaatttacgtaactcatgcgaatcgtatatttgttcaaggttccaagccatatcattatactttttatagtttaatggagattctaaataaaaacaattaaatatatttctaacctcttgaaataatttttttgattttttcaattttcttaagattattatttctttctcagtcgatacatctgcaaaagcactaaataaagctatagaataaaataactctctaattgcacttattaaatcaagatctttatcaacagcttgtaaataattaaaaatacgttcaattttctcttcagattcctctgattcaaaggaattaaatttctctgcattttttctatatgcataatattcatcaaatattatccttgcaagtttaaaccaaatatcttttgaataatatatagacttatattcctcaatccccacataatcaacaatatctatattgcttttagcatgaaaaaactcatgggctaaaacatcagcgaatttttcacattgctctatagtatattcacgtactcctccaccacttccaatacctaaattgattgatgctatagatattattatttctattctgtcatctttaacgtttatttctgtctgtccagcacaatccaatacattcattatttttattttctttatatgattctcaattcctactaattcataaacattacgcccttttttaaaatattcatctttattagaaaaagatattgggaatctcgcctgtttgccatctacataaaaacacattaactgctcaaatgaaggtttatctgcagatattgttgaattgttgtcacaagtttgtaaagcacttgttttgcaattaatacttttcttcgccaatttgctctgcataaatatattttttaactttatcataactattctccccatatacctgtttattacatgattggctatattttgattactattcacaatttaattatatcatatactttctaaatatcgcattattcaattttcaaagatcaatttttcactagactatattaaataacattttatctccttgttgtctcaataaattcatttttggaccttatctttgtattgtaacttattcccactcaataccttttagtatattatctatttgcataatttcatttacggttaagttcttataaaaaacttgacttgtcttatgattataaagtcttatttctactgcactctcttcatcggcttgaatttctctataaccacataaacatttatatacacctggttctatttcttttatgtcagttttgcatactggacattttttcattttaaccaccttcctagttacataatatatttcattcctggatctactatttgaaagaacacttacttatttagttgtattgcgcactaagttaactcattgcctgttaactgataataacaaggtttttttatttctaatttttcagctttatttatatcagttgttattataaagttttctattaatttatttttaggtaaactaaatatgttttctgcagctttaggattaactacaatagtaaagtcataatctactaaaacctcaagcatcataattgctgtttctaatttgtattttttcattttatcttttaccattttatttttaggaaactctataactttcattgtctttaaatgcatatctctcaaaatatccctccatatttaaactaaaaattaaaataacccatttctctttgcttttataagtttaaatgcattttctatagattttgaatctttctccgttacaactattttttctttagcaacatgattattaagccatactgtttcattaatccaatcaatttcaatggtatatggaatttctccatagtctttagtctccatagttctacctctacctaattaaatccatatcataaattgtataatcgcatctatatattaatagatacttaccatcaattaatattcccgtactttttggaatgtctgtagcaaaataacttacattatctccaacaaatgttgctaacggttttccatcttgggatcttattaaaatcaccctttttttccctgatgtgatatttttataactgtctacaatatttcttaaaaatggacgtgacttgtcctgattaataatttctgtagtttttaatgtatctttcattaaatcttgtaatccatcttcttggagaattaaactacttccaacgtgaattatttgattattaccaactgttatatttaatacacttgatttttttattgtttctcccttttcatcctgctctttaaatttatcatctaaagatatacttatacttttaccctctatcctatctaatggtttactttctttgtcgtatgttgttattattgcattcctacctttaaaatgctcttgcaattgtttatattcattttccaataaattacacccagaaacaataaataacgaacttactaaaactattgaaactataatgctttttattttcgttttattcattctaaacatccccttcacaattgtttcattcatggatctaatctttgaattatggaattaaattattttcaactgtttacctttttcaagatgtaattttattctttccttagctttattgcagtacttcttttctttctctatacaaatataatttctatttgtatttatacaagcttcagcaagcacacaacttcctgcagtaaaatctagtgcgataccttcctcatttgtataagttttaattaaatattcatataactctatcggcttttgagttggatgtatcctatcttttatcttgattgtgttatatggaatatctattatagttgttggatatcgatctgtttgacctccaccttccatacctattttagtcttaccatagttggcgcctgcggtagtgtgctgcttatatttctttactggcttatgtccgtaagtcttctgtggattatagactggtaaatttttataaaatatagggatatctatatgttgtcttaaaggcatcctattagcatttaagaaatttgatttttctttaggcttccatatccatgaatacctgtagtactttttatttgaaactactaactctgatgtaaatactccagccgccattaatgctatagatgcattatcttttgcaattctatttatctcctgccacattggctcaaaaggaattgctttgtcccattcattattagtcattccaaatggtaaatctgataaaaccatatctattgatttatcatctatttttttcatgatttcaaggcaatttcctaaataaatattatttacttctagcaatatatcaccttcttttctgtcaccttaatttcattttttcatgaatactagccaatgtgtctttgctcttttatttcccaataaaggtttataatctataacttttaatatatcttttatttttatttgttcttcattccatttaaaaatcaatattccgtatttatctagaaccctcatgcactcattaaatccttgtcttatatctattggccaatcactatttaacttcccatatttcttggccaaccatgaatttcctccagcctttattaaatgtggtggatcaaaaactactaatttaaaggtattatctttatatggtatatttctaaaatctcctagtatatctggctcaataataagctttcttccatcacataatgtatcttctaactctctgttatccataaaaataacatccttattttctttatcaaaccaaaacattttacttccacaacatacatcaagtattggtttttgcaaatttatcacttcctaactattgcacaataatttcatagattataagatacacctacgcttgaattgtggcattacatcattgcttctaaatgtaattccctatacatttccgattcaaatacccaatctccaatatctttatcttcaaagtcacaatcatgcgtattgtaataatattttccatttttcaattcaatgctacacacttcactttcaaagaatctataatcttcgtctatcatataggcaatatcacctaattgaaataattgttttgtatttttgtttgctttttctattaaattctttagctcattaaaccttaagtcaggtcttttggtattacatagagcaattattttatttttttccttgtctaaaataaaagcatctgtaggattttcaattacaagttcatactttttcatccccaattcactcccttacaataacttcattcttagacctatttttcaattgtgacttagctaaatcctaaatccaaaattgtccattgttgcctgtatatcaccattaaattgaaaataagtatacaggctgctttccttggttggtactgctccaaaaaactttaattgatttattaaattaccttcttttttattactgaattgaacttctgttttattttcacctattaattttactttcattttatcccctccaaacttacccttttatatcttctttaaacattttataagttaataatacaaaattatctttcaagatgtttacagaaattatttcaagattttgattcctttttatgaaatcttgataatcatacactgcttctaacactgttacccctgtaaacaattttgtttttatcattaataatcactccatttatttactttgtatttatttcatagttttaataactctttgaataccttttttaaaaatttaagttgttctttattgaagtggtcttccttaaaactatttcttgagccagcacttataataattccaatagcaaaagaaagttcctcagtattaagagtattaaaatctaataagcaaggctctgcatatatagcgttccatatctcatcttttcttttaattgatatcatttaattttctcctctctaccttttattagatctattttgcaaattaatctaagtttttacttatgccctgtttttgtcttagaattcttatttttaattaatatactggtattataatttttattataaaaaacactagtaaatttaatataaaatttactagtgttgtatttctttatgataaaaattataatatagctaagagaataaaattatgatatattttgtaccatccccaaatattattattctctctccaaaagaagttgttggttatttttgggggtggtaactagtggatagggtagacataatcatactgtcacttatatcattgatagtattaatcatagtattatcaatggttttacctaaacaaagaaaattacaattatttacattgaatataaatatcttttttataaaaataaatttaaaaatttattacaaaaaataaaaaagtgtaaatacataccttcacaaatgtatttacacttaaactgagaaatatatcatattgttaataactaacaacttctttacctacattataccttatgcatttattaaagtaaatatgatattaaactataacatagcacttttctacaacattctattgtatacagctaatgaaaattttcatttaatcttttataaccataaagtatatcttatagtttattataatctttttctatatcatatcaaatttgtgtatttttaaatatcttattagtactgttatagtgagtttctatatctcttgttatcattacttttgcatacctaccaattacttgatcttcgatttctgaaatatcgttttagtttttcttaacaacctgcagttcaaatgatccttctctatctcctggtaaaattaaataagattctcctaaatctgacaatactttttagaactataatcacgcctactatttgaagtgttttgtttttataatcatatttagaatatcatgaatgattgtcaagcttcgcttctaacatttctttaaatgtattcgtaaataaatcctctaatgtttattaagcatcttttgcacttgtagttttaattgtttaataaattcttttcttgaaaaagacataatctgtgaaaaccccataaaaataatataataatcgaaactttaatttatacaatataaaatcataaatattttatcatttattaatgtatattttatctaagctctcaaatcttactaaattatatttcctattgcgaacccttaaacctctctattaaaaattatagtattctttttaaaaacatcgtattgctatttaatataaaatatttgggatagtaataattctgcaatcattatcctaattactatcatctatttccttaccatacttatctcttatttttggtactaaagtatttcccatcattcctgattcactatattattgtatctctattatttattagcattttcaatagcaattattgacttcatatttttaataccaatatataataattttttgtacataagatatattcaaacaacttataatgaataaactaaaagatgtagtttatttaatattaaaatttagctacatcttttaaacttaagattttataaacttaaacttttcttatataaaataggtttgctgagcatatagttatattattcagtccacccttcatctttaggaataaactgccaattacatcccaattttaaattatatggtttcctttttacctcttttaagtaccatttacttatacaaaaataatctttatactcttcaaatacaattccagattcgtagaaacgatgaataccaatcaatcctatctcatcagtactttcttcatcttttttaaaaagcaactgacaactatatgttggctgttcatcatattcttttatttgtatagtattgtaaaactcatcagaatcacttataggagctaaaaacaatttttcttcctctttcttaaaatatttataggtatatactctccactcttgatttaaattaaaaaaatctagatatatataatcttcttttctaactatatcatcatttatagattgagaatttgactttcttcttataataaatttttctccaatatataaatctctataatttatatatttagaattttgattatatttgctacgtgttaaaatttcacctacaggtgaatctttctttagtttaatatatgaatttttattccccgcattaaacatataatattctttattgtacattaaaggatttccccaaaaatcttttaaatattcgctatatgattgaattttatatctttcttcaatatttgattgacttaattccgtattaaaaatactgaaatatttcatccaaataaattgtgttctatctatatcaccatctaatttaaatattatttcaccattagcaataacttctcttatatctttaatatctgtatttgattctagcttaccattaatataaattttagcgttattcaaattattagtaatagttacaaaaaaccatctatttatatactctgatatatcttctcttatgttatattcaaaaaataccgatttggtttttccatttatatcaattaaagtccatattatcctattacccctaatagatattttccagcccgaattatttttcatacaattaattattgtatattcattatgaatataattttgtataccatcattcttatatttaggtattcttatccaaaagctaacgctaaaatcaaggaacacactattaaatatgatattctgattttgagtcactctaatcttactatttgctgaactagttaatttaaattgatttttatcattaagctcgactccatcatatacctctacctttgccccatatcctgataaatctattaaattattatccttatatcttaaatttaagataatattatttaaaatttcgctattatatttattaaacatttctattagtattgtatcattggtatatattgaaagatcaaacggcataatggttttcaagtatttatttacttttgatttttcatattctgcacttccaatcaaatataatttattttcatctatataatttaacaaattttttttgagagtattatcaaagtctagtaatttttctacagctaatggaatcatttttttcattaaatatgatacagaacatccatttataaaattatttatattatctatagcttggttaataccctcattaagtttagaatttatatcattaaaatcgatgttaatatttgacttttctttttcagaatatatattatatctgtattttattatttcttccaatgcttgtgcttgataatttaaagccttatacattccctcttttattgtataaaattgagtattaactgttgagagccattgcgctactattaatccgtacatatcactccatttttcatttcttttagttaaagcattatctattgttttaataattttatttttattgtcaatatatgattctaataaaaaggctccaactacaggtattaaaagttctggtataaattctagtagaatactggctcctgcaatctcaaaagcattttcaaaatttcctttagctgtttcatttcctacatttaaagctaatcctatataaggaacaattagagatatatctgcaattttatccatagtattgcttttattagcttcgattacaaaatcatttactatctgtttcacccaacctgcaaataatcctgcttctaccactttattagcagttttaatataatccatagaaaaaaatgaataaactttgttagaaaataataatgcatcatcaaatgaagatgttaaacttatatctcttatatctagaggaaatgtctgagagtataaatattgaaagatggtattttcatctgtaaaaattttttttatagcgggttgtttttcatatactggaacatctacattaaaatcagtaagtgattctgtattttcacttggtaattctattttacttattaaatcagtatctaaaattaattcatttatagggaagtcattttctatataattactctgtgtattatattctattctttcgtttttagataaatcatctgaaaaactatttttatcagctataaagaacaaatcttcattatcaacatcaatacatattcctggagctttaacacttttacacatttgtatcttatatacagccaaatgctccttgctaatttcttcataagcttgtttatttatagctttattctgacctctatattctttttccatatctttatcagatatattaaacccttcctctatagtatagatttcattatctaataaattttttatttttactggtggtaaggaatcactaaaataagaagctctagtttttattttataattttctgctatattagtttctgtaaaaccaaacattaagcttttatataatttatcaaaactttctacatctatactatattttccctcagaatcttcaacgaatttatatttatctttaaatttatttttatatatattaatattaatgttaggatctgatatgcaaactaaaaccttgttaagtctatcaactatccctctaaaattttgcaaaactttatcatagatacttttatccgtagaaggagttatgatgctgggatcttgtcctccaaatgtatatagttcttctgcctgtatagcatctgtagattgcataaaaaattttttttcatttggtacaattggtaaatcatctactttaatgccatataatccatgtaaaacatgtataagttcatgcattaatatcaaggctggatctgaaaaatatccacgtctattaaatatacttgcgcctttgttttcttgaacattattaaatacgcttacatattctgggcaaaacttcatttgcattatacccccgaagccttcccttgatgcaaaatgattttgtatacctatatctatagtctcattttcatttaaaactggcccaggtccaaatattattaaatttgcgaaaatacctttttttcgctccacttctcctggattactgattaatttattaacagttacactagcaatgtttgtgttaaactcttcgagtggaacacgtctatctccaagataaggtataccatttataatcatctctaataacttttcacccaatggttttgatttgattctattaaataacttgatcattgtttgtaaaaatatattctttttatcattagtatttaagtaatctggatcataatattcacaaacatctctattaaaaataccggaacttttattaaaatcctcaggtttatatccaaaagtatatctttccggtattatccaaatacgatctgtgattttaaaagctttataatatctccccgtacctctcgcaaatggaggctccatcataataatattattattatcaataggatcattataattaaaattatttattgtaactggcataaatattctcctccttattttaagtttatatcccttttaatgcccataaatgcgcagccttaggtatattgtcattattattacatatcatccaattataatttctatctcttaaggataaagataaatatttattattataagcaaatgtaaggcaattaggcataaatatatcgttattaaatattattctctttgcagtatctttagagttaactaattggattctattattttcagaggatatatctacatatttttcttcatctcctaataaacaaactactccttcatcccacttttgaacatattgcttgtttgcgtcaatatttattaatttaaacttagcaccttgaatattaaggttatttgtatctttaattgacaaatatatattattgttttcagtaacttcatataacgagttttctgggaatacataattgtatagttcataggttttattatattctaatctttctccagaaatatcccttatatatgagttatttaaataagaaaaataattatttacaacttcttcactggtaatagatctatttaaaatagataatccttcaatatatattggattattttcattaactaaagaaattgtattacttgaataaatatttaaaatttgttcaatactttggttagcaataagtttatcattaataaatattaataattgatttcttaatctatctatagaaattgatatataataccaatttttacttataacatcggataaataaatattctcttcattaccattgcaatctacaatgctgaaaactaatccattattttcaaaataaatctcccatccacaattatcagctttattttctattagtttagacgtaataatatcttctcctaaatttcttaaccaaaaacaaattgaaaaactattagttaacccattttcaaaagccttattagaaaaactaacactttcatcaggttcttttaaatataatgcatctccatttactccataaactaaactaatagaatctgaatatttaactaatgtattcttaccagatatgtcttcaattactttattattatcttcctgtaatgtaaataaaaacagattataatccgactctttttcttctttaattaaatcagtttcagaagtaattaaatctttaatactttgaatatcaaaaaactcaaaatctatattcataaatgtatttaatttaattaattgtaatttttcatcttcagtgatattagtgcacttttgtataaaagctgttacattactatttacactattaatacattgttccataaaagaaataaacttaggatatatatttgtatcaaaaacacatatagctgatttatttaaaaagtcatttatattatttattgctatttgtgattcatttgataaatctataaaagttttctctgtagctaagttcattaaatttaatttatccattgatatatcagctttaaataaatcttgaagcttattttgtattatttgtttaattagcttttcttgagctagtattgactgttttgccatacaaattaaatcgaaatactgactataatattctgtccaccattgatctaagaaattaaaataaacttttttgaaataaagtatattttttaaatatatgttaaataatttttcatttaaatcatttagtggtaatcctaacatatcgttagggattccataaatctcaattattggcatacttaaattttcttttttattaataagtgaaattggtcctaaattttgaaattcttctacaaaagaatcggatgtatttaaaatatttaatgcttttccaaaccaagttactactttattaataccgcaatcagtattaatttcttgagttgcagtaatatcaaaagaataatttctaaaaatctctcttaaccataaataatattttttatctgtatcaataggactattatcctttatggaatctaaataaaacattacattagataagaaagaatacactaaagatttatctttagaagaaactacttctacaaaatctgaggataaactaaatttttcattgttagtattttgagcttgtaaataatttataggccatggtatatttgtattaatttctctagtacttgtaattttctgtaccggtgaaaacttatcacaattttccttataaggatttacatctataatctctggaatattgtctattactccaatgttaacattatctaaagaagaatcatttgaattattaaaatgatattcataggctctattatatgggattttataattactgtaaaaatcatctacagtgctttttaatccatcaccataaatattacttctcattaatgaaacattatttccatttaataaattaattatttcttcaggtttatttataatatcttgatttctatctgataaagataattgaacattaatttgaccattaacaaaaccatttatactataattttctggataatctattttgtagtattgttttctataaaaatgtttaagtgcattattaaatctatctggcatcataatgctaaactctttagagaaataatttaaatttaattcccatatatcattgatattgattcgaaacttttgttttaatctcaattttatatcattaccaatggcattatttccttcaatttgtgtttcataaatattcctatgatcttcaaacactttttttgcatttgagaaataattatctgtaaaccaatatggatctgtatttataaatttaggatcaatgcctccagatactagtaaatcaactatattcaattgtgagtattctatattctctaattcacttcttaatctatatggaataactaaatcatcactcggttttataccatataagaaataaagagattttattaaacattttattaattctattgcaggatcaatataaaattcgtcatatttataggttagaaatggttggaaccatatttcagtcattgttcccattccattttctgcatcttcctttttataaaaaacagtattgttttctactatgtttgctcctggaccaaaaataactatattagatgcatagaaacttttattatcttcagatgaaagataatttgtttctctatatcctgcataaggaaatggaatagtacttgaaattaaagaattcaattttttattagattttggtgctgatccaaaagtaatcatattaggtgcataataccctccacctatatatccataaggaaatggaatagctgtagaaatcaaagataataacttttccccagcgttagtactattaattctttttaacaaagtaataatggcttgtaagaacttatctttttcactatcttgtgaaagaaaattagaatcatatattcccccatcaactttatattcttcatctatactcaaagattcgccataatatctctctggcgccacccaaatattgggagcaaccttaaaagccttaaaaaccgtatcagtttttctagctctaactactacaacatttttattatctaccggggaatttatacttaagttgtcatttatattcatatctaaccaccctcctaaatttatttcaacgcacatacttttaattatttactatacacgcccccttaaattttggatacatttttcagtatattcttatcatttatatataacatagccacactattttttgtaaacctaaaattttttaaaaatataaactacatattaattaattttttcaatatgggttctaatctctctaaagccattattttatttttatatacagattgacgacttatattaagttttttagctatatctatctccttaatatcttcaacaaatttcatatatataattttcttttgatcgtcaggtaatatggatattaaatcattaaattcaaattctgaataacttgaataactatttgctattaagcttaatttcttatctgcaatttctgaattatatattattttcttatcaatctttcttttattgcaaatatctaagcaatatctttttaaagtcctactaatatatctctctaaatcattttgtgtattgaaattgctcaaatcaacttttttaagtgtataccataaatggtacaaaatatcattgtaattatcatatatattatattttctagtaaatatatttatagttttttcaaaatgcttaaaaatttcttgaaactcctcattgtcattttttaacatttcaatttgtaaaaacaacttattcatatttaccactatccctccataatatacatattattgttttattatactataaatgaactaattgcctttaaatttttaataagccatttttacgaaatatccataatcaattatgtaaacatactaataaaaatttgatatatttaaattttaggtttacaaaaaataatttgattatgttatatgttatatgtaagattaattattaaataaaggaggaattataatggaacactattcaacaatccaaaattcattaaatgacaaaatcgttaccatctcctgtaaggctaatacagatttatttttttatcaagttcccggtaacggtaacgttagcttatttcaacaaactagaaattaccttgaaagatggagaattatatatgattctaataaagctgcttataaaataaaaagtatgaatatctataatactaatttagttttaacatggaatgcaccaacacataatatatcagcgcaacaagattcaaatgcagataatcaatattggttattattaaaagacattggtaacaattcatttattattgcaagttataaaaaccctaacttagtattatatgctgataccgtagctcgtaatttgaagcttagcacacttaataattcaagttatataaaatttatcatagaagattatgtaatatcagattttaaaaatttcacatgtagaataagtccaatattagccggtggtaaagttgtacaacaagtgtctatgacaaatctagctgttaatttatatatttggaacaatgatctcaatcaaaaatggacaattatatataatgaagaaaaagcagcataccagttttttaataaaatactttcaaacggagttctaacatggattttttcagatggtaatactgtaagagtttcttctagtgcgcaaaacaatgatgcccaatattggcttataaatcctgtttcagataattatgacagatatacaattactaatctacgcgataaaactaaagttctagatttatatggcggccaaacagcagacggaactactattcaagtatttaattctaatggaggtgataatcagatatggactatgagtaacccataaaattaatatcaacaaagatttaatatgaatactatcatctaatttataaagaggtgaattatatgtcagctgaaagaacttttctacctaatggtaattacaatataaaatctatcttttctggttctttatatttaagtcctgtatcaggatcattaacattttcaaatgaatcttctgcaaataatcaaaaatggaatgtagaatatatggctgaaaatagatgctttaaaatctctaatgtagcagaaccaaataagtatttaagttacgataactttggatttatttctttagattcattatctaatagatgctactggtttcctattaaaatcgctgtaaatacttatattatgttaagtttaaataaagtgaatgaattagattatgcctgggacatttatgatactaatgaaaatattttaagtcagccactactcctactacctaattttgatatatacaattcaaatcaaatgttcaaacttgaaaaaatataaaggagaaaagtgtatgaattcatctataaaaaaaatttataatcatatacaagaaaaagttataaactatagtgatactattgatttagctgatggtaattatgtagttagcagaggggatggatggatattatctagacaaaatcaaatactaggtggaagtgtaattagtaatggatcaacaggaatagttggggacctacgtgtaaatgataatgcgataccatattattatccaacaccatccttcaatgaagaatatataaaaaataatatacaaactgtatttgctaactttactgaagctaatcaaattccaataggatttgaatttagtaaaaccgctccctcaaataaaaacttatatatgtatttacaatatacctacattagatatgaaataataaaagtcttgcaacatgaaattatagaaagagcagttttatatgttccatctcttggatatgttaagtctatagaatttaatccaggggaaaaaataaataaagatttttactttttaactaatgataagtgcattttaaatgaacaattcctatataaaaaaattttagaaactactaaaaatataccaactaacaatatttttaattctaaagttagtagcacacaacgagtattgccttatagtaatggactatatgttattaataagggtgatggatatataagaacaaatgataaagatttgataggtacattattaatcgaagcaggttcatcaggaagtattatacaacctcgattaagaaatacaactaggccattattcaccacaagtaatgatgcaaaattctcacaacaatatactgaagaaagacttaaagacgctttcaatgtacaattatttaatacatcaacatcgttatttaaatttgtagaagaagctccttcaaataaaaatatatgcataaaggcttataatacctatgaaaagtatgaattaatagactatcaaaatggaagtattgttaataaagctgagtattaccttccttccttaggatattgtgaagtaactaatgctccttcacctgaatctgaagtagttaaaacgcaagtggctgaagatggatttatacagaatggccccgaggaagaaatcgtagtaggtgtcatagacccatctgaaaatatacaagaaataaatactgctatttcagataattacacatataacattccgggtattgtaaataataatccattttatatattatttacagtaaatactacaggaatttataaaattaatgctcaaaataatctaccatcattaaaaatatatgaagcgataggttctggtaatagaaatttccaatctgggaatttatgtgatgatgatattaaagcaataaattatattactgggtttgacagtcctaatgctaaaagttatttagttgttttgcttaataaggataaaaattactacattagagtaccacaaacttcttctaatatagaaaatcaaataaaattcaagagagaagaaggggatctccgaaatttaatgaattcttcagttaatataatagataatcttaattcaacaggtgcacattactatacaagacaaagccctgatgtccatgactatatttcatatgaatttacaatacctggtaactttaataataaagatacatctaacattaggctttatactagttataaccaaggaataggtactttatttagagtcactgaaactattgacggctataatttaattaatatacaacaaaatttaaatctcttaaatagtaccaagtcaatacgtttattaaatggtgcaatttatatattaaaagtagaagttacagaattaaataactataatataaaattgcatatagatattactaattaatatattacgatttattattaaataagagtccaccagcttatgaagtgcactccaaagtttagataaagatctaaatttttggaggtgcatttttgtgacaaagaaaatatattcaacttttcaaattaaagctatagtatatagcttttctaacaaggaaatcatattttggcttattttaaactcacattttttcaccaacgccatattatggcaatgtaatcaagaggaatataactaaatgtctaaatattaaaacttattagtttatggattttaaatatttgctttaaatttatattattaattagacttttaatgttataaattattaatatttctaataaattcattttttttactgataaattaggaacagctaaaaaagatattaattttttatataaagaggtatagaatagtctaagtatgttataaagaccattccattactattatttgcccctatcttctataactttactatctaagttttatagtaaaatatatgttatctagcaatgattttgcttcacattctatatttttttaatctagttcccatttgtaaagatattccttctttaatattttttataaaaaaataaagtaattcaatttaaattactttacttaaataagccttatgattatctgtttaaaattaaatgtatacatgcaaacctcactagatataattattactaatataacaatagataaatatattaaaaattctatgatatattttttatcacacatactttgtaactcctataattgattttattaattataagattattattacattatttcttctttattttataatagttttttctaaattcttttggatattcttaagttcttccgggaacacaggtctatactttaattttaaatcttctattatttcatcatcaaattcatatttttgttcatacaagcctacaagagcttcaattatctcaattcttttataaatatccattctatgttcttcacttaaattaacatttgcaaaagattcctttaaataattataatattcattcacttttggatgctttattttcataaatcattctaacctttcttaacattttctattataaactaatttagttgcgattatatgcgaaattttaaaatgcataaattcacctgctattgttattttgtttacctttaaaacctcccccgtctttccatttaaatatttaatcaattattatatatactaatttttctaaaattaaacacaaaaaaagcatagaaataaattcatatgccatagcaacttatatatatttattatttaatataataataatcgtactcttttattggatttattctttaaactatactaaaatataataataagaagtagacctaagtaaaaaatttataatggaaataaagtttaataaaaaaatataagtagataaaagaacaaattatgttaataataaaaagatacatatatagctgcaaagtttattaaaaactaaaaaccacgacgttgaaaggaggaaaaagtaaaatctatggatataccagatatacccgaatatttaattgaaactatatttgaaaatatagatcaacggctaaaacaaaatttctataatttttatgaaaatttatttaatatgaataataaagaagaaaatttaaaattattaataaaagatattatacaaaaagaatttatggtagctgaactaaccaaaatatcagatatggatttacataaaacaaaacatacttttatagctcctgataaaataaacaaactaaagagatataatttacaacaaataaaacaaactaaaaaaagatggtataattcattatttaaaaagaaaaaaacaaatccatttaacattgaaattgaaactgctaataataatataactttatatggtcctgaggtattttttaatttatacaaagttagaagtattgaagaattaaaagatattagagcagctcaatttaaagattggctagataattctatatttattacagatttcttttatttaaaaagtaagacaaataagcagattaatacagcttttaatttagattttatatataatatctgtacaataatctatgataaatggaataacaatttaaactttatatatatggagtacccaaaattattattggatcatcctttagttgcggatgggagcgggaaaattaaagtacataaacaaacaattattcagcaaaatcaatctaataaagatgttaaatataaatacaacgattatgtctctaaagatggaataactagaatattagttcctgaatctaatattgatactaaacaaagtagacttatagacaataaagatcttaatatattatctaatattcttaaatataaaaaagcagattttctgaccaataagactatagtttttaatttaattgatattataaataatatttattgttctaaaactgtccgttcttatgaagatttaagaaatagaattgcaaaaatgacattattgaaatttaatttttttagaacagataatacttctggcatccctgatgctgtttatgggattttttctagttacgagtatttagataaatctcaaaacagagttaaagtttatgttgatagtattttatatgataaaatactaaaaaatcaagtatatacaatatacaatgataaaataaatcaattgaatgatgattttgctaaaacattagtaatatatcttcaacaagaaaagctagtattatatactcaaggtaaaaatacaactttcttaagttatgattattttagtaatttagttagatttagatataaaaaagaagaaagaaactataaaatcattgctcaagctctagaaaatatgaaatgtaataatataattattagagattttaaaaaacatatgaatggatttataataacatttttagatacaaatcaatttgaaatttccgatttattttccaataaaaatacaagtgacataatccccatgatataaataattaccaaatactcccctacctatctggtgtgggagtatttttttataaagaaatttattacaatttcaaaaagtgtttcatttctatcgttcactttttaaaaaatgttttatttttatcgtgtactttttaaatacatttagtattttttataagggaaccaaaaagtgtttcacttttgtcgtgcactttttaaatatatcattatctattcctatacttgtcctaattcattaatttttaagaaaaatttgctaataaaattcactaattttttataaaaagtgtttcatttttgtcgtgcactttataaaaagtgtttcacttttatcgtgcacttttataatttattattttatacactattataattgaaatttatactatatcttataaaaagtgtttcatttttgtcgtgtacttttatgatttattctttagttattttattatatttaatctcaacactagtgattatatagtgttctaaaaaagtgtttcacttttgtcgtgcactttttttataatattaggttgttgtatttactttatttgttcaaaaagttgtttcacttttgtcgtgcacttttgtcattagacaaaatttattctatttgcaataataaaaaatgatctaatatattacagaaaggagcagtattttacatatggcattagcaatagaaaaacttttttttaatgtaagtaaaaacttaatacactttattacagagccaataccattatatcactataagacaatttcatttaataaatgctgttattgtcctttctataaaaaaatgaatgataaaaacatacataattattgttctaattattgtaataataaatataaaaaagtcataaaaaaatataacatttatagtaacataaatattgataagactcatattcaattttctttaacacaaattaaacaaatgctaatttattattattatgcaaattctaagggattcgtttctttgatatctaaaaaaagaattgctaaaatgataggttgttgtgaaaaaacagtagatataaataataaattattttcagatttaggtttaattttaattagcggtactataaataacaaattttctttaattattaaagattactctgaacactatagtaaaaacaatgcagggtatcttaatttggctacgaatgtttttaaggacttactacatatcaacaatgtaaatgctttaagaatagctctccaaggcatattaaaacatgacataaatactattttagatagggaaacttatttttctattaatagtatgaaagcattcttaccagagtatataaattgcaagtctgctatagaaaaaataatatgtaaattaaatagcaatacaataactatgctttttaacagctctgaaaagcttatatttgttatctctaaaaatctacatggtaaattactaaaaaaagaaatgtattataaatataagaataactttttaaattatattacagaaaacaatattaaattaaataatttaagtcattctattaataatattgtaaaactttctttcgaatacgggtatgatattgttcagttaatgttaggagaaataaaggatatagcaccaactatatttaatgttggtggatatataagagataaaataaaaagatacatttatatgaatgaacctttttttgcaatataaattaaggtctttttgtcatgcttatttttaaattttattattcattatttacaaataatataaaaacttatattatttgtaatataagtttttataaattgctctcattatctatttatttccattcactgttgataactttggaaaaaaatcattaacatagataattaaataaattacactaataataaaaactattaacataaatacttaattttcaacattaagaataaaaacaattctaacaatttatatatctactgatattactatgttctgaaacaaatatttatgattaatatttgtattttaatatttgttctttaatagctcttttcatctctaaaaggaaagcttaaattttctatatttattaaaagccttttattcagcttaatactatataattttctatatttataattgcatttaataaaacacttaaaaggggctgtaatttagtttttataaactaaattacagccccttttataaaactaacttaaaattactatcaataacactaatagtatatttattatcagttcttttttcagctattatatactcgttttgaatagctttttttattatatttataattttttctttaaaagttgggctaaacatttttaaacataaatcaaagtccatttcagctgatgttattattgcataaccggcttttttatattttagaaaatcttttttattggttttaatataatgcatatgatctttttcttcagttgtaaccaataatgagtttgtctcattattgacgtaatataatatttccattcttaaactgcctccatcttcatattctttttatctaaacctttctctattttacgcaagcttacaatgccaatccctttaaactgatatagttgcttttttgaatacattgatagatcttccaatgtatttatacccatatttctaagtgaattataggctcttattgataggtttagttctcgtaattcatctcttttgttttttctcattttcttatttccccctaaaatcatattattttgtactttatcttagtagctaggcctcctcttagatgtctttcagatttattataatctaatactttttgcacctctttagctacttcaggattgattttaggtagtctttcggttatatctctgtgtattgtactttttgcaaccccaaatactttagctgtttttctaacagttgatttagtatttatcacataattagatacatccaatgctctttcctttatataatctttcatttataaaattcccctttcttttagcttttgccaacttctttatttcctaataagttattattacaaaaataaaaactaggtatatattttatatacctagtttcacaaatttatttttttgtaaataagttgttatcatctattctttccgctattactttaactacttcattgaattcgtttaaagtcataatattttttaatacaggcttccaacctttccttaaattccatattgaaatacagctattcattccaccgccatttaaatcttcattccgcttaattcctttagaacattcacatttttctataaatccagtttgtttgaagtaatatatatcacttatactggataaattcgttttatattctaataattcaatatattcttctgttactaatattttttgattactatttaatttgttaataaaaattttttccattcctacaatccttcctatctaatctgatataatttttaattttagtttttaaaccatataaatatataaattattattgcaaaaattacataataagtaaataaaagtatttttttaaatacttcaatatctattgtgcaatcttttattgttctatattaatattacgttaatgctgaagggttactatatttaatttttttaatatagtacttttcttattcgttacactttattttttatttctaataaagtgtattaatttaacttattaatgctatattattatactaataatgattaataatgcttttatacgtgaactaatataaagatatctagctattaaagtttacattatataaactatgatatataatcttaataagaaatattgcaagaaaggatttaataaatgtatgagaatttagatattttccaatttggagagtatattattaatatttttagtgaaaaaaagtataaagaaattgatgtgttttttaatgatatgcatatgaaaattgataaagaatctactgttaataatatagtacaaagttatactaatgaaatagttgacagctttcagaatacaagtaactgtaataaaatttattctatatttaaaagaaaagactattaatgataatttcaatacattaatagtcttttcttttaaatattttataaactaccccatttgtctttattgttttctactaaattaataagtgcatcatcttctttacttgattgattgtttttattaatagaaacttttttaggagttgttttttgttccatattttccgacaatctattttttacttcattaaattcttctggatatttttcattaaaatactctatcagaatatcttttattttatttgatctatttcttttagtggtaatatcatttagaatttctaatatagtcatatctaatacttcatcttcatagaaggcaataacacttctatttagcgactttgatgtcattttctttcaccacttctaacttatcagcatattttatattgctatattctttcaagccttcagctattgtatattgacttctattattttgtactaataatggaattttatatgcttgtttaaatttatctgatagaatagttttaaatgtattattatttaataatccacctgaaaaaatgaaggtatctactgtaggcatatatttatacatgttattttctatagtaaagaatacatattctgcatattcttctaagcatctatttaatatattttctatttgttgttcttcaccatataagctataattaccgttttctaggatttcttgcaattgactgtaagagtaataagtaatttttttatcttcattttgtctaattaatgcttgttttaagttattataaattcttatgcagccttctccatctagtaatgtatcacttgccataacagtttgcatgttcttaacaagcattaaatctaacgtagaatggcctatatcaacagagaaaatagttttattcatatcatttctaggtaatgtgaatataggactataagcctgtggtaagcaagtaacatcttttatgtaaactttctttttaacttctccaaaattacaaagataactaaattcaaaagcagatccttttaaccaatcttcaaattttttactatctccttttgatctattaggtaatccaacacatagatatagattaaattcagattctttagtaagttgtcctactatagatagtaattcgattaaatgatattcatctttaattctatctctgtttaatctttgcatagtatctggatatctttctatgcatgcatctccacaaataaaatatttaccattatactttattaaagtattttcatcatttaattctttaatagtatctgctatatttaaggcttctttttcagttatattattgatgtaatttttcatttttacttcagtatcatttgtcatacctattccatatccaaaaccagtatcaacaccagcaattatatttttcataaattaatccctcctaaatatgcttgtccatataattttaacataaattataacaaaaaatcaataattatcattattatttaattaaatataaaaaatcaatgataaaacaattataaaacatttaaagtttttttatgttttataattaaaataataatatttttatgattttaaaatatattaaagttatataatgattataaaacattaaaacacaatataaatactttataatgtgttttaataagtaaaaatagatttatatgctttttaatgttaaacataatatattaatcatatttttgattaatttatatattatgtttaaaaactttaaaaaactgctacatttatcatttataaatgtaacagctttttgttttaagagtttttaaatttttttctaataaagtgaattacataaactattataataattacaatagtacaggatattactttaaatatttttccacctacattactagtttgagatttggctgaatctgtaccagctttattactcttattaataactactggtacaaatgtactattatttttagttgatttttcatattttgaatctcttgtactgctggtgtttggagtagatttattcttattaattgtatcttcatttttagacttagaaaaagaatttgatttaaaattactattcgtatttgatttatttgaattttcttttattgaagaattactgggtgttttaactgagttattagaactaggtttaattttatcattagatttccccttatttcctgaagaaaaggaacttgatttaaaattactatttgtacttttggttgtggaagaattactagatttaggactaattgcagtactggatggtttggatgaacttttagtagaaaaagaatttgatttaaagccactgctcgagttagaccgactagagcttgatttaaagctactagaactacttctactccctgaagaaaaggaacttgaagaaggtttagaagaaaaagagcttgacttaaaactactactatgtgatcctcctttagcataaattgtatttatatttgaaaaaattagagcaaatgtacatatgaagcatactatatatttcattaaattattttttttgttattcatgatagtttgatatttaatatatagtttatatacattaaatatcattttgcacttcctttctttagttatatttaagttaattactgaaactcccaagcctaaaggcatggggttcttaggtactatataacttctatattatctccgaaagtataatatcactaattattttccctaagactttcactatcaaagattgctaccaatctattaacgatagtataacgcccatttcaagacgttttaataacttatataccaatactacttagattattttttaatccttgtaatctcaatatttctttattgtgctatccatcccacacctaaaggagtgggctttccgcacagttttgtaaaattagtttttatattgaatatttaaaaattattaaaactaaaatgctaaacaatattcctatacaaatagattttatttgaaacatagatagttctcctatgatttatatagattatagtttaattacttttctgagaatagaatatttcagcaatcttatctatttcgcttccatcttcaatttgctcaaactcttctccatgtattgttgtgaagtaatataaaatatacttatcttcactatctaatatgttttctaatagaatatattgcttattgctttctagtaattgtatgattgctaatatcttaaagtttgtatcttctccggtagcgtcattggttaatttgattattttatcatctctaaagatagttatattaaaagtgttatgatcacaattagatatacaagaaccctctttgcagcctaagcaagaattaaatgtgcagtcttttacacagttaaagcaagagcattttaagcattcttctatctgtataaaattttttatatgcttttgtttaaatttttctaattcttctttatatttgctatcgtttttaaagtattcaaataatcctttcccatcagcttttatatttgcttcatcgattaaatctaaatattcttttaatattttagaacttgaataaaattttcttaattttagtttgtcttcttcaagtaaatcttttaaattgtctatgttaaacaatatatcggtatattgtttactgtatttctctttttctttagtagtaaattctataattttattcataaaactcatcctttctatgttatttaattaatagttatagtaatttttatatacaaatttctcaataataattctataggaaaagacactaattaccttattaaaaagctaattagtgtcttttagattttaaaattaaatttattatattctaatctagttttcttttagtctctgaatcagatcaagtatttctagatataaccaaactaaagtaacaagtacaccaaatgctgaataccactccatgtatttaggtgctccataataagctaattcatttatactatctaaatctacaattaaatttaatgcagcaatgactataactaataaactaaagattatacctataataccacctttatataaaggaatttttattccaaaggccaatgataatattaaagaaaatagatttaatattagaattcctacagtagctattatgattccagttacaatttttttatttataggcccaattgatttataaataaccaaagaggatatagccattgctattgttaaaagaaccgctggtaaaacaattcctggataacttaaatctgtgaatttagaagcgattcctaagagtactccttctgttattgcatatattggagaggttatcggtgatactttaggtctaaaaatggtagtaaatgctaaaactatactaattgtaacacctataattaatataaatctaaggccggcactatcatcaatcattgtttgtgaaagactatctattttattccaagaaaacataaatgaaatagttagtaataacaataatataaaggttttattatatgtgcctttaatagtcattgatttgtcttcatttaaaaatttacttttctttatacctttttctaagaagggatttggtttcttattcattaaaatacctccgtaaagctttattgatgtcaaatttgtgttctaaaaaatccttctaaatagaaggattttttaattaagatttgtatttttctaactcagcatcaagatctacttcattaagtttgtcaaattcattatctaaacttacaggttttaaatcttctaatcctgctgcagttgtttcttttttgcttatttttctttctatatcatcaagattaatattatctgatgatacattgcatagtatttcatttactttttgactagcttcagcagtatttaacctagcattggcttcatctctatactgcctagtttctgatattgatttttctaagtctgctaatctgctttttaatttttcagcattttttttagcttctgcatgttttgactctaaatgcttatattgtttctcagcttcaattttcttttccaaagcttttttagctaattcttcatttcctatagataaagctttttttatttttgtttcataatcttccatttgagattttgcatcctgttttttttcttctaaaaaatgcacatttcctaatacttcagcagcagataatttagcattgtgtagatcctcttccatatttcttattttttcctctaatgattctattggattttcagctttatccaatgcattatttgcttttgctttaatcatgttattaatttttgagaaaattcccatgtttatcaattcctttcgtgtatgttttataataatatattatttcttttaaaataatttagtagaattaatatattaataatttatatataccttttttacaataaatttgcacaaataatttataatttcttatattgatctaataattctttattgtaagtatttttatcttttagcattattaatgaactattatttttactgtttttcttcatttgcttctcttttccttcattaattttaattacagaaatataatcatttaatattctataagtttcatttaattcaaagagtaattctttatcaaatgaatcatgactataaattgaacttttatacacatccaataaatcaaaaatatgtttaaacaaaggttctttttctattaacaactcttttagggaaaatataatttcatcaactttatctaagctagatatttttatatattttttgtttttaataattatatttgaaataaattctgctataattctttcatcaaagattctttcatcaaaggaactccaaaaattaattattatcaaagtattgaaacatgaagatacaaaaagtaatacaaagtttaaccaataataattgccgttagtaatgataagtgcttctttaatagttaagcctaaggaaaacagatgaataatgatgtcgataatatttccaattgtctggcatcgttgttctgtttctatttctttttttcttaaattttcttttagttcacaagttatatttaagtctaatatctcatgcattattttattatattgttcaattttacaattattgtaactcatattaataccacctttctttaatatttcgcttcctcatttattagggtaattatttagggaaattattttatgttgttaggatagcttttttaacattgttataatttatatatacctttattacaataaatttgcataaaaaataacacctatattctagaacttaataatagatgttatcttgaattttagagttttaattattataattgcattaagctaaatatctcaactgttttgtatcatacctataatggccagctatatctgaattaaaaccataagtgaaagtatagctgaacatataaagttcatattaatttgcatacttatcagttataattttaattttttttgcaatagatttgaagcttttcagtaatttattagtaggctcttcatttgttaaatctagtagtatattaacctgatgattaatctcttgcatatcatattttgtattgttaggtatagacataatataatcacgctcctaatactatgtagctataactacatagtgcttctattccaataaataatctaaaaatatataagctagtacttcatttctagttaattctttataaacatcaatatcaatttttacatttaaaataaataagatagatttagcattagttttactttgtgtgtaataagggctcaaattctctaaatatattacaggagcagttaatgagcttagcttaagtatataattatttgtattataattattattttcataaataatatctctaattttttcaatattatatattaataaatctgtatcattaataaatttatttaatgtattttcataatgttcttcccctacaaaaaaatcgaattcttcatcttccttaagaattcgaagtatatctttagctattattccagaatctatttgggaaagcaattcttttacagtaatactttctttatttcttctttttattttaaatgcagaaaataaatttatgggtataataattgggagaagaataatatccaatattgcgaatatgaaaaattcaaaaggtgaatacattcataaagctcctttcgttaatatttcgtatgtaaattcatatatacattttttataaaaaatattagcaacattattttttataaaaaataaaaagagaggaagctaaaaataatattactcttagttttctctcttccttagatagatttatttaacaagatgctaaaaaaaatatggttaataaaacaaatgccacacaacctaaaatcactacatacttttctgttttgtctgattttattttatcatcaactttttttattaattgctgctccataactgaatctttttctgccataacaacaggttcatcttctatcattcctactacaacttgtattcttattttacccttacccaagtcacctagttttaatggttcctttacagctttatttaatatcaaacttgaatattctccgtctttaccctttattgctgtagcttcttcaattgatgttatttctctatcaatttttttattactatctactaggattggcattggcataattacattcgtatctgcttttactggtcttatgttagtaaaacataaaagtattaaaaaaaagaaaactcttttacaattagacttagataacatacaatatccctctctttattggtaaatgtaactatagtttattatcaacttttatattttatttgtagaaactcatctttaagatctaatattttcttatcatctatttccgtaggattctttatttcttgtaaaactgttcttccttcaacattttttaatcttgtctttatatcttcacatttagtataaagtttatcaattatataggtttctttttcatctagtttcttacttttcttatagtttactatatcttcctgtaattctataacactatcataatttttagaatcaacttttaaagggctatttaatagtacagttgtacttattatcattagtattatcaatatactcactactaatataattctatcctttgaattcatgaacacatacactccttaatcaattctaaatcatctttaaatgaacctgggaattaatactataagtatagccagtaaagtatgtacaactattataaaaattataatattagttaatgataagtacattaatactgcaaaatctaatagtgctacaactatgctgatacaaagttctttagacatataatgcacttcctttatataaattttgtttaataatacattaaaaataaaaactttattcatttattatgctatgaacaacatgcactaccataaaaactaaaatctctatttttcataacttattttatataaaattcagccatatcatcaagtcttatacaagcaactttgccattagctttttcaaatacacaaccacaatcaatatatatagtcccatatcttttaagtattctaacatcatcataattatttgttattgattgtactggagtatgaccacatattactgtataatctctatatttttgttctttacctatattttctctattccataagcaagtatcttcatcttgatattttataaaatcatctatacttaaataattacaattatcaggaaaactcagcccagcatggacaagtataaatttatctatagttttaatataaggtaattttttaaagtaattatataaagatttatcgtatccaatctctttatttactatttgagaatgcgtaatttctccaccattgtaataccataaacttatatcattattttcataaaaatctatatacatttgttcatgattacctttaagcaaagtaatatttttatgcaatattatataatctaatatttccaaaggattttttcctctatctaaaatatcacctaatatatacaattcatcatcatttttaaattctatctgatctaacatcttaatgaatttattatagcaaccatgtaaatcactcataacgtatttactcaatttctcacttccttatgatatcccgtgtacacttacacaaaatacttattattatccttttaagtacagtagattaactgctttttgccattgaatggatttacattctgcaacttttaagtttttttcatttaaaatagttttagatagtttccaattatttttagctacttttaattctttttctgctttagttaattcttttaaaaattcataatataacttactgttcatttttccctccttaaagaaaatactaagatacaaatctttatttcttaatatttaacagcttttccctttgtttctgcacctattaaagcataatatccagacttattagattcataaaatttcattgcaattcctctctttcattttaaatactattgttataatttatatatacttttattacaataaatttgcataaaaaaataacacctatattttagaatttaataatagatgttatcttgaattttagagttttaattattataatctccttaaattaaatatatcaactggtttgtatcatacctataatggccagctatatctgaactaaataccataagtgaaagtatagctgaacatataaagttcatattataactacatagtgtttctattccaataaataatctaaaaatatataagccagtacctcatttctagttaattctttataaatatcaatatcaatttttacatttagaatgaatagaatagatttatcttcactttcaatgcaataaggcagtaaacgatataaatctataagagaaagtgaataccacgatgaagctagtgtaattatatgattgttagtgttatgtgtatttttttgttcagatgtatctttaattttctggatatcatttgttaataaatctgcatcattaatgaatttatttaattcatctccatatagtccagtttctttataatcaattaatatctttaaaatatctttagctattatttcagaatctatttgggaaagcaattcttttacagtaatactttctttatttcttctttttattttaaatgcagaaaataaatttatgggtataataattgggagaagaataatatccaatattgcgaatatgaaaaattcaaaaggtgaataaaacatttttaaggctcctttcaaagataatattatataaattttatatatacattttttatagaaagtaaacaaccttaaaactgtatttcttagatatattagcaactttaattttatctttattttaaacttgtatataaacaaaataatttattgaattgatatgtaaatgaagtatttattttgatactccattatttgatttgaatatatgatactaattatgaaatagattaattaatcctggcaatgcatttggtataaatattaatattattgctaaaataaataaataaacagatctaatgctaatgctatagcaccaaacacagccaaaactattagaacatatttaagtattttggctgattctatattatcattaatcctctgttctttatcattaactttctgttttaattgctgctccataactgaatctttttctgccataacaacaggttcatcttctatcattcctactacaacttgtattcttattttacccttacccaagtcacctagttttaatggttcctttacagctttatttaatatcaaacttgaatattctccgtctttactctttattgctgtagcttgttcaattgacgttatttctctatcaatttttttattactatctactaggattggcattggcattggcataattgcatttgtatttgcttttactggttttatgttagtaaaacataaaagtattagaaaaaagaaaacttttttacaattagacttagataccataaaatatccctctcttcatcgataaatgtagttataatttataagatagatctaatgttatagctataacaacaatcacagccaaaactattagaacatatttaagtgttttgtctgattccatattatcattaatcctctgttctttatcattaactttctgttttaattgctgctccataactgaatctttttctgccataacaacaggttcatcttttatcattcctactgtaacctctattcttacttctccttttcccaaatttcctaatttcaatggttctcttacagatttatttaatactaaatttgagtatcttccatcattgctttttataactgtagcatcttctaatgatgtaatatctctgtcaatttccttactactatccattattgacggcggcattggcattggggtagttgcatttgcttttactattcttatgttagtaaaaaataaaagtattaaaaaaaataaaacccttttacagttagataattttttaaatttaaacatcatatttttatcccctatcttatctgtatcgctaattatttgaattacgtttagaattcttttacccacattctttttgaagcgtaatatattcttctatttttacataacatatggcatctgcttcaatttcacatagtaatcttactttcatttttacacctcgctctaagtcacactatactcaggtcctgcagctgctctttggattacgtctttaccatattataaaaatacaacacacccaaggataataataggtgctataaataaacattctaatatgataagatttcttatacttattttttcatcatgtttatgtacattaatgtacataaactctataattggcattgataaaatgcatatgaatataatgccaagcatattattaaaatgttcaaatatattcttaattataataaatccctcctataaacatttattttgcttcttcataataatttcattcctgaaccttatctttgaaatgtgaattaattttttataagttcaaatctatatttttgcttaatgcttggatatttttctttatctatctcgctaataaacatttcataaggtcttacatagtccataccatcatataaagatttataaacaacatatttcccattacctattgtccagtttttcattggtataaataacttattttcatcattatatagaactcttactctatgtgaagtttcagtttcataaaaaaatcccaattctttaatccctttatatttacgtgcatcaaattcatctactacttctgctacacctatagcgacatacatataattatttaaagtaccactttcatcgtgcttaaaatgcttataaattgctggaaatattaactctcttttcacacttaattcctccttatattagctttacactcatttcaatcctggaactaaatctttgaattgtgcactagattattttaaaattttttctttttattttagcttcaagctctacatagtaatttgacattttaaatttatcacatttaaatttaactttatttctacttaagctctcatcatccattccgtaatagtaacattcatcacaattaaaacaactatcttttttaatttctttacattcttcagtacttaaaaatggatagatttcaacactatatttacatttatcgcaacaacatctatcacatatagttgcgtcatatattttatgttttcctataggctttttaatggattctaaaaatgaaagttgttcattcctcaatttatcaccttcaaaatatttagattatgaactaattattgttagtatatttttgtctttatttttatttaaaataaattttagaaattcgtcttttattttacttggtatgcttgggaaaattataaacattcctggaagtactttatatgcttcaatttggtcattataagcttctttaagtgtttcacatatactgtatgtgtgtgacttaacttctccattaaacaaataatattgttgtactaaaaacatatttatcacctctttgtgccatgtgaatttcatttctggaccttatttttgtattacgccttaatcccatttaattttttgaccacatgtaccacaatataaatcttctacaaacatagaacaattagggcaatatgctattttatctgtataaggataattaggtttttggggtatttgctttttacataactttttaatgacattctttttagtaatagatacttcttgccaacaatctattgttcctaatatactttcacaaatacattttaaactcattatatccccccttgaattgtgaagtaatcttctacatattggtcatattcatctggttcaatatattctaaatattttctattagtatccaatgtaccagctaatcctattttcaagttttctgatatatcatattttagatcttctggtatttgtttttccgtttgaattgatgtttgtatataagcctcacaatagtctttcaattcttcgttccaacctatttcagcttcttttaaatttgttgtttctgcgattaatggcaaaatctttttctttttttgatattgccggatatctatatatttttaaaatattttttattttgcatttcaaaaattcaaatttactccaaaatatataataattagtgtctgcgaggtcagtatatgaatatacataagagtataaatatccctgctcttttaatatagaaattagcttatcttcaataaaatcattgatgaatctcacctcatcatatttattgatgttgaagtcttcacatagtttcttcacttgttcatacatttcaaaaaacatacgttcataaccttttaccatttcctgtttgattttcttttcaatactttcaagaaaaatatatttattgtcattgaatattttgtttgctataggtattaatttatttttaaaataaaattcttcatcttttttaattatttcagcttctttctttaatgttgcaatatttttcacaatagccctccttttttattaattaattagggtataataattacaatttttttcagctatttaataatgataaatattctcctattaacataggatttgctttatttttattatgcattttctaatttttctataattttttctataacttctgaggggtagatttcacacaagattctagcatatgcttgacatgctcttctttctatttcctctatctttacatctttagggaactttataattacatttcttatttctgcaccttttgccacaagcgataccacctttttataaattttatagataaaagttttgtttctatccatattctcaatataatttaaagaattaataaatacaataatactgtggctttatttgtattagacatatagtgatatttttcaaaataaaaaacacgatatattattttaatataccgtgttaaaaaaatttattattaatccaaattatataatcctaaatctttatttgcttgatgcataatacacatgaataatgtatttgcaatagcagcttcttcttcagattttgtataacccataagttcttgatgtaaacttatgagatcttttaaattatttttagatataatatttttcattgtatcaagtacttctttatatgcaggattctttattgcatgaaagaagccaaacatattttctaaatatccatatgccttgatattatcttgaaattttttaacgctatcaatagtatttgggaaaaatactagttcaacaatactatcaatattcttttctttcttttcttttaattccatattcattacaatctccactttaaattttagctattattagccatataattttatacataatctatatactcttatttccccatatgattcctaatccatttttctatatcatctttattaaattcatctttggctatactaagacctaattttattagttctttttgagtatagccaatattaatattattaagctgacataacaaacagagtagggatatacccagtctcttattaccatctagcatacaatgattattaataactgaatagcttaagacagcaattttctctatgtcatctttgtataaatccattccagcaaaggtttgaaatggattttctaaagcacttttaagaagtgctttgtctcttactccatgacttccgcctgttttatttataatcttcctatgaagtgttaaaacttcctccattgaaaatactagcattttcctaattccttcaatgcttttagattgtcttctaaaaaacaatccattaatttctctttatttttatgtcctttattttgtttgttttgtaatgcaaccttgagcaaactcctgcgatttttcattttatttgttaagttttcataattctttaatgatttcattctagttcccccttaaattttagttaagctatattaaccatgcgatattatctaattaattattattacaaataaaaaacatagtatattaaaaacatactatgttgaaaaacttactattagttgtaagtattatatttttactatttaattttgtagtttttagatatctagggtcttattttaatttttttattctttcattttcatcttttattaatgaatttagctcattatgtaattcttctggagctttggaattttttttaccataaagttgatttacatagaaagtatgtttacctttagaagttttctttttgatttctatagtataccttttatttttgtaagttcttgtatatattacacatctacctttattaatcttatcatcatatgaagctacacagtttctattaagcacagcttcctcaattaaagctttcttggtttttattagcttatattcttttggcaattttaattttaaaaacacactattttcggggattttaattttttttacaaatttactattatatattattgctaattcattatgttcattaactaatctattaaaactctttatctttaaattgaacttttttttcatttttataatcataaaacaataatcttgtatatataaataatgatcacaatcatcaatataattttttacgtgtttcttataatacatttgaaatacttcactaacggaaaaacattcaatcagttctttatcagaaagactttttaatttttgatattcttctttttctatatatttcatagcattagccattaaatatgcattaaatattgaatatttatttatagaattatctagctctatattaaatcttttttcaaacaaatcttttttagagtgagattcccatacaagggatagttgtatagggaaagagttaatatgactttcattgtttagataatctcttaaaacatctttccaaaaaatatttttatttgaataataatccatgatgagttttgtcacatcagaatttacccagttaaaactttttaaattcgcaggaaaaaactttgaatttctatcacaataaatatttttttcatcatagactactagtttactattaattttcttgtttaaatttaaatttttcccatcataataagctgaattggattcgccactttctataataacgaattctttctcttcattatcttcacttttgcttcttatatattctatattacagtgattatattttatataggcttgtaacttaaattctgaatttttcacagcttcaaataatttcattaattgatctttttcaaacataaacaatccaaaattattttctgtaattttataatgtattatttcatatgtatcattatcaatgatgttatttagcaaataaaagaacatctcatatgtttttggatttctaagttcttttttcattttatttaatgtttctaatgtacatatacttttttcacaaaataaagggttataatattgttctttcatatcaattatcacctactaaaaatattatcttttctatgtgtttacattctatttagctactgcttttattgaatttatagcaaagcattataaaataaagaacacagtatattttttaaatatactgtgttaagaaaatttattattaatttattttttagattttctattttaatggtatagattttgtttaaacaaaatctatcttatttctatcataatgttgtaaaaaactatgataaattattttttcatctactactaaaatttttgccaatactggaactggcattgctatttttgtatttaaataatttatagttactaaatcataatagaagtcttcaccataagaacttaaataattaaaagtatttatttcttttatattttgaatggcatagcttaaccacattaaatttttagatgcaaaatattcatcatcacactcaatttctttattttggcatatttcaagcaatttatttaaatactccttaattttgtcttttctttcttctaataaactattaaagttgtttatttgtattattgctccaatatttctagcttgcaagtttaaagctaatcttaatttatcagactctaacatatatgtacgataaattaaattatttttatcttctccatattctttgtttactctagtttcaaaattattaagcccttctaaacctatatcgtgacaaccttctgcccaatgtacattaggttgtccgtcaccgtcttcgtaaaagtcaacccatttgtgattgttgaaattattcaatcgtgaatgatatctttctttaaaagccatattctcactagattcacacttactcaaattccgcacctctaatataaaatcgttcattacttattcctcctaaaattttaatccttttgttctaattttttaataaaatacattttttataagcagttataactatcctccattaaactttttaaaattctaatattatattcttctttcaaatctcctaactctttttggagatcttgcacatcgtttttaagcttgtttatgtttatataatctctattacagttcgctatatctaaacccatttctagatcagctatgtccatataaattgcttctattttgctagataatttcatatctagatcaaatattttataactaacctcttggattagttttttttctaataaactttttaaatccactgtgcgagaaaaaaagacattctcaaaatctcttgtattagagaaaaaattaatctctccatctttataaattaagtaatctcctgtttgagggtgtggtacaccaagggtagattgataagttcctaagcctggcatttcatcatacattaactctgaaatatatggttccaggtcttgatctaagtcttttactattttaaagtaatgattattcccatcatttaatttttcaaatttgtttttcatttctaattcccccttaaattttagctattattggccatatattctatttgattaattattatttcaaataaaaaacatagtatattaaaaaatatactatgttaaaaagttactattaattgcaagctctatctttctattacgaacagtaaataaatggtagtgggttagtaataccttttctacgtattaatttttctttttcaacactactaagtatcctattctttcctattgttttagccgagaatttactaaggtgtcttttaaagtaattatatgttgttttcttttcacattttcctaaggcatataaaatttgtctatttaaatctttacaacaaagtatgcctaattcaattctatttaggaatttcttcttcatatatggtcttatgttctcatccacttcaatatttctctttagatctttaaattctttatatgcatgtttagcattgttataataactttttgtgaatctcttttctaaaaatgcattcttagcattgtttatgtcattaaatgcccaactaatatcacttgatgcatgatattcatgaatagtaatagtgtgttctactattttttcttctggtggacatatatcatatttacattctgttataccacaacatttacaacattcaaatccctctaaaattgaacaactcaccgtatatttcttacaatccttacaactcatttttttctttcctcccttaaaaatctatccttaaatcttagttatattaaccatgtacgaatttcttggacctgtttttttgaattgtgaattactttaattgattgatttctctttttactatttcttctgtgctttcttttttccaactgtataactctgctgcaatcatatccccttctttacaattccagtaaggcatacttgcaaaagctccactatcagttaaataaaactctttttgaatgttgtattcttttgatttcacttttatcttttgtttgtaccaacgtgtgccagcataccaagtcgtttttttattagatacaactactaccttgatagttttatagtaaagaactggctgttcctcaattggttgattaacttcgccttcacaagcacataaaagtaaacttaaaatcaatattaaaaatatattctttttcatttctattccacctttttgaaatgtgaaacaactaactaaacaaatctatctctatatagttgaagtctgtataatcttcaaacatattttgaccttctaaatagtagaagacaattcttcgattatagtcaatctccataattatatacttatgtcttttacagtactcttctatccattttctcaaaacgtccttgaactccatcacttcaccgccatatgttgaactaaaaaactcgttttattaactattaatcattaatctttcatattgtaaaatttgttcatatgttaaccattctggtttttcattatcagaaaaactattatataattctttcattttttcaatctgttctttttcgttatttgcccacagatgatttacatttctgtttccatatcctaaataatactcacaatcaattcttagtctatctaataactgatatttaaagctatcttctttatttattggttttgatgtgaaatgtatttctaaatcatttttgatagggcaatttggttcgccttcaaaatcattactacaactacataactctggattatcacttccaagtgttatatctttatataagtttcctgtttcaatacatttataaactggcctatcccaatcatcaatacctattaattccactgttctaatattattactttccattttcaccctcctaatatttttcaatcttataaacttctttcttacacattaatttaaagattacgtcttaaattaaaatttctcaataattattacattttcattattttaaagtcacacaaccattttcatcgactttcctgagtatcctttgacatctcttacatgttacttcactagtttctcctatagagactttatcttttatgtcccatcttttattacatacactatagttatctacttctcccataacttctgctttaaatccaacatgtgtgattttacctcttttaattaaacatactttcataatgcaccttcccttctattttttagcttacataagccatatattccatttaattaattattatttcaaaacaaaaaacatagtatattaaaaacatactatgttaaaaaatttaatattaattgtaagttgtttcttagacctgttttatttgtatagtcaactactcttctaaatatttatttcctatctcacattcgtcaatgttaggttttatagttttacatatttcatataaagcacttaaataatcacttctatcattgaaatatatagcattatttgctattgcaaaagccttatcaaacctttttgaaatcgtcactcgctctacttctactatgtgcataccatatcgtattgaactttctagtaatctatcatcttgtttacttaaccactcttcggcttcacttttatctgtaaaacttgtaaaaatccctttttcttctttatccataatgtcataatatttcacattaattcacctcattttacttcataataatttcaattatggaactaatctttgaattacaaagtaaaattatattctgtcaaaatcaaaattattttcattacacagtttttctagttgctctatatccactatatcataatcacttattgaataagtatcaccaattggatgactatcatgtttatcatgatagtgaatataaaatatcccttcttcttctaataatagtaattcaactttatctactccatatttattaatggcattattcatttctgtaactatctcagttataaacttatacggtttcgcttcttcaatagttccaatttcaaaactttgagtagcctcctcccaaattctatcttgtaattctttattgttcatgttgttaactaattcttttgcttcttcctcattgtttgcatttacttctatggttccaaatacattccaatttacttgataaacctttttacccatatttaaaacacctttccttttgcaataattcgcatttatttaaaatcgcttactatatgtttgtgctatgaacttacttgcagatttttgagcctgtttttatgacttcttccttgttataaaataatattttgcctatatctttttttcttatctcttgataagagaaaccacaacctttattattaggaataaatccacgttttgatgtgtatccctctaataaaattccatcatctaataaccatgcttttcttttataaatatttttcataaattatctccttcagctcacaatcaaaatataatcttatatttgtattgtgaattaatatcttaatgctttttctaattctcttattggcacatattgtgctatattatttttgcttaatttatcaataatttcatcacatctattatcatatttgcaatcagtacaagttatatgtttaggacattcagtctttattttcctagcttctcttttccatcttttatttttcatattttaattaccccactttataaacaaaatataatcttgtctttgaattgtggctatctaaactcatgcagccattcttgaatattttcttgaatattttcaatatcctcactttcaaggtaatcttctagtggtaacacttctctaacttgtttaagaatgatattagttaaactctctgtatcaaacctatcaattaattcaccatccaatataaaaaatccatctttattaaaatatctaccaactacttttccctctgtaccagaggctcttactataactccatctacagttctagcctctatatttaatcttactaattgacctcttttatatttgttcattttcttcactccttcatatttatttcaaattgtaacttaaacattatgataaaggccacaatcaccccaactatattcttgatgattacaattaaacatatttatcatatatttataatccattctatttatatacctcttggtacgtcatattaatttcatctaaaaatatatcttcttatttttcccaagtggaaatcttctatagtaacattttccttttttttcttcttgctgaatacttttaaaaagctccttaagttcttctaatttatcttcaaaacaatctttcctaaagtaatctttattatttattctaaactcaactctatatttatttattttatatccctccatctttgtattacgaattatcgttcttcttgacttttatcacaattctctacagatagttctgattttgctaaatcatatattctgtcaagtaaattcattgaaaaatcaaatatttcgctataagtactataacttatctcacccacagaattgaggccatttaggaaatctgccatttctgactttattttttctttaggggtagctgtttctgagattccccaatttcccatgtaattcactcctctacattaatttcaagttcagttattgcatattttacaacagctgtttaaatgtcgtatcaatagccatatttatttttacgccattcacttgcttcttctgcacaatcctcatgcattaattcgcaccaatcttcatcattttcggaattacatacaccatcgtgataaacttcatcattatctatatccttttttgatataactttatggcaccaaggacattccacctcatctttatccgtatcaattaattttcctgataaatttttatatttcatctttatacaacttccttcctatttttttagcttacataagccatatattctatttgattaattattatttcaaaataaaaaaataagcatctgatagtctattaaaaccatcaaatacttatttttaaaacatatatttaattttcttatattattatttaccaagttcttttagtgcttctttattattatctataaaatcatccattaatttttctttatcttttttttctttatatttaataaactctatatattctattacttgcatctgctgctgctgtgatagacctttaacattttgaaatatcttttctgctaatagcatacgatcccttctctcttattgctgttatttatatatatattactatcatcactaatttttgtaaagaagataattaatattcattatatatattctagttaggatttagaatttatactctatttaagaaatgtaaaaggacctgctaagatatgaacaggcccttttgtaaatacaaattagaatcctatattataatgagtttgggcacctttaaatccgatatcattagttaatttttcattatgatgcaaattggtagcgttaaatccattaacaggcaccttaatttcagatttacatggtatttgtactaacttccttattgtttgttttgtacctttttcttcatctagagtatagcttctagaaacgtaggcctcagcaataaagctaatagttaggagcggattatcaccggcataatcaaatttaaatatgcatgttccaccattttggtctagtttgcaataatatggagaagtataatgtgttccatgaccaccaaatctatccaatctatgatttactgaccatttttttatagtggctcttactccatcaatatacacaggacttaaagatatattcatagtatactctgtttctttacccttttcgtccaaatgatatctggtgaatgggaatttagcatcagtatttattatcatatgtgctgatccgccactgcttccgccactaccattgctacccatattgggagtaaaacctgttgttttatattcccatctataacgctttacttgtctttctttttgaacacgtcttgtttttgttacagttttactgatttgtacttttacagcgtattgtaaatattcatgaggacctccggaggaatcagcagcaggagagtgatttactgttttctcttgtacaatattataaccagcaaattgatttccaacttgttctctcgctgaatccgtaaaacttttattgggatctataggtactgctataacatcactatagagccatttaaaagtataacccgtacttttatatttttctgtagtccaatatttttcagtggtccaataacctactctttccatatgacttgtatctatatatggtgtttctttattactattcttatagtcatatacactagcagcagatacaaagcttaacttagatattaatataactaatataaaaataatagttaataaattagctttcttcatttactcacttccctttatatttatcaaataattattatttcaaaaaaataaaaacaactatttcttatctaaatagttgtttttgtttaaaaaatttattgtattatacagaatctagttatactaattatttcatcattaaaataagttatacacactaaagcatttttggggaaatcagaaggattaaatgcaataccactagtttgggataaattttcaatcaataaaacacagtcatttttaatggcataatatttaccgtcatctaattttacgccactatcgtcagcatatgaaacaataccatataatttaataatggtattgttattaatgatatttttggtatgaaaaggttcgctataatcaattaatgtatacgtatctgtacgatcaaacgtatgcattaatatagcattctttactagtttatctttccacacacgttctggttcattatatttatttttttgaataccttctctatcaaatgatttatcaaagaaatctaatctttttcctcccatccaaggcgccccgttaccatatgggttaccagtgaaatcacctttccaaatggttatttctttaccgttaatgttttgtatttcttttttatatccactggttaactttttctgcccctcaggcatatatttaggattaagagaagggtcttttatatattgcactttttgattaataacttgtacataaggtttaatttgacttgtatacttatctaagtccatttttcccattatatcaaaatttaatttacgtgaactaatgctatttccaataccaagcaatattacaactaaaataagcccttttaattttttcttaaccatgtgtcactcctttctattctaaaatttaatatattttaaaataacactgctattttttgaatatcttttattttatcattttctttagatattttaactaaagtatttttaggataatactttgctgaataatctgttgcaccttcatacaactctactggactttcaaatgataaactaatattatcttttttaatattaaagtattgaccattatctaatttgataccattttcatccgctgatacaactttagcataagtcatgcttagtttaacatttggatctatttcattatttgtaatagtaaacggctttttataatctataaaaatgtatttatatttatcgcccattttttgtttaaatgcatacatattcttaaaaaccttttgatttttagctgttaggaattgcacatttaagtccatgttttctttgctacttatagtttctttacctggagaaattattgtttcagttacaaatccttctttatgggctacttctaatattttttcattattaacatgaattactgttttatctttagtataatcaaccttagcatttcctttataaacagttatatcacttttatatattttttgtatttctttgctaggcttttcattctctttattctcccctactttttcttgtgtattttcaatagcttttgtatccttggatttattaaggcccactgctattccacctactataactacacaagcaataattattgctgttatcttctttttattcatataaattacctccaaattatgtctctatctatatattatttctatttttagcaatctttatatttatatattaagttaaaagcattatttatacaacaaaaaaacaaatatccattatagatatttgtttttttactaatttaatttttatcatgaataaatataccttatataagcaaattatgttgtttacatatctctttagataaagtttttattccggttttaaataaaacaatgatattatcacctttaatttcttggattttaccttctccaaactttttatgatatatgtttttgcttattatatcattgcttttatcattattatctttattcttatttattttttgtaattcatatataaaaacagaaggatctttttcattatataggatatataaattagctttagctctagtacatcctacatataatagtcttcttgttgattcaatcatttcatttactgcttccgtaggtattttctcctctttttgtttattaaaagtatcaaaaatgttattattaatatctgtaataataacatttgaccattctaggccctttgatgaatgtattgtatttaaagtaatgtttgcatcttcatcattttcttgaagaataacattatctatctcctttattctaataatgaattcatttattgtattagtagttttagctatatatttaatgatatcaactatctgagaatcagattttttatcattatttaaatactctttatattctaaaatattaaatacaaagcttataattttagcaggattagtatgctttgcgagctgctcaaaatcaaaacaaatatcattaattttttctaacatatattccggcatgtctaaactagaatggtatcttctcatatagtcaaaaatgttaagatcattactaaattcattgtattgtttacatactttatttagcattgatttacttatatatataggctttattttataaactatctgcaaatataattcagcattgttcatattttgactaaaataatagattcttaatatgtcttttataattttatttgttgataaagaaggaaatttagcttttatattgatatggatattatgattaatacaataattaatcataggtattgcagacatattatttctatataagatccctatattgccatttaaatttggaattaatttttcaaatattgttttattggagctctcaaaatctgtaaagcttcgtaattctatacttccttctgcatcgttagaggcaatcatttttttattgaatctttctttatttttattaataaatatctcattgtatttgactaaatttttataacttctaaaattttggtccatatatattacttgggtatttttatattgtttaggcaaatttaacaataacttagggtcacttccttgaaactcatagatagtttggtcatcatctccgaaaaatgctaaattatatttgtccttatttaatttttcaattattttgtattgtaacgggctacaatcttgagcttcatctatttgcatgtattcaaatttattaacatatattgatttaatttctttatttgcggctaatagattgttagctatgattaacatatcatcaaaatctatataattatatgttttttgagttttataataattgctatatatatcaatgaaatctgtaggtaaatcaaatagttctattttagttttagatttttccattacttgctgtgggtatataaaattgtttttacacaatgatatcttattagaatatagttctagttcatcttctgaaatttgttctttattatgttcaaaatagattttagaaattatagttttcttattaataggatctttataattttcaatcattttatatttaatattattcattttaaaatatgttctactaattaaataacataatgagtgaatagttgaaaaatgaggactatatttaattgaatcaccaaagattgtattaaatctatttttcatttctaatgctgcagctttactaaatgaaatgcaagaaattaaattgggatttatatttctaactaatattaaatatccaattcgtataatactggataatgttttaccagaaccaggaacacttataactagtaccactccttcagaagttgtaacggctttcttttgtttgtcggttagttttatttgttttgtttgtattaattcgaaaaaatctcgatctgtcatctttccattttccctttcttcttgatatatttaatgagttcttgccctggttgtacatctctatttaaatctaatttgatcttttctttagcttttaacttatcgtatttttctttctttaataccgttgtataattgaatgatattttaaataattttgctatttttactgtttgtgttattataatttttttattgaataaatacaattcattgaatacaataattagcacattgctaattctctttgcatatttaattgtacaatctaaacatttaataatgaaattaatgtatacatctggcatagtatcgcccctttcaacataataagcagagaacataatcattatattctctgcttaaaaacccgttcactttaaacttctctttaattaatttgttattcctcaacattagccatatattctgaaacattactatacttctaataataattcgtaacatcaaaaagtacactttaaatcaaatatattacatcctcaaaatttgaataagataaatctatctatatataattattatacatttattaaaaaatttattaaaaaatacaaaaaaagtttcaaaaattagtacgataatatttatatgagataataaatatatgtaaagttaatatggcaaattgctaaaaccccctaaatcccccttttcaaaataaaaagtttaaaagaaattttaaactttttatttttttatgttcaatatttcttatatctaatatctccattagtggttccattaccattaatcttccataagcctttcttagcacttctagcttctctttcacaatttgtaaatgtatcaacatattttacatttggagggaatgtactttgttgaccaaatccatttgataataacatagcattaaacattttagaatttatttcttgatcactattgctttcaggtatctctagccaaacatatcttagcaatctgccatatttatcagtattacttatatctttttctaaatatacagttttatcttctaacatagatcttgtatataaagtagcttctcttccaaagtcctcatgcttagtagtgtcttcaggacagttaaccccaatgaatctaaccctttccccagtatttaaaactatagtgtcgccatctataactctatatacagttgctttttttaaacttagattattttttccaggataattattacttttaatattatttattatggaaacattatccctcacaacatcttggcttaatttagtagcttcattaatattttgacagcccgtaagcaaaacagttattaaaataataggaataaattttttgatactcataaaattatcacctcttttatcagaatattttagtaaaatagcccaatgcacttaaatgtatttcttcagccatagtttatttcaatcatagttttagttgttgaattcaaaacttttcccttaatttatattttaaacaaggaaatcattttaatttaaaacgataaagtattttacaatttatcccctaatatattgtcaataagtagatgatattgatcattcttttgacttaacaatttttctacagaatctccatttatccaaatatattttatataattgctatcatcaataatctcaataaaatattccccttttacaaatatggatttacaatcttcttttaattttactatgttataatattgcattcttttattggaaaaatcatcttttaatattatttctcttttaggttcacaatcatttgctttatttataagtatacttttatcttcaataatattaatcatctttaaaaactcctttataacattatttaattaattattatttcattattcaaaaatagtacagctctacagggatggctataagcgttgatttaactagcattgcgctatatctaaatcgaatggacaagtttcgcgaaatcagcatttcgcgaacttatctaaaaaattaagataatagtatatattttgatcaaattttaataaaatattgtttctatataaatagcgattcttcataaaaaaattatccccttccaaatttaattatggaaggggaatactttttttattttctttgattatgttttaatataatgttgagatgtagtctaaaaaattatagattagattgttcattcaaccattttgctgcctaatttattcatcttctatttttacaaaacctttctcaacaccttctctaagaaaacattccattaaatgattaccattgccaggaaaataaatattattttcttctaattgttttaagaataaatctattttatcttcactcttatctttttttaataattttaatattaatttaaacattttaaattcctcctacttttattttaattgaaaatttgatattatctttattattttaacttacaacatttataactccattctatataagtaggtaaatggctatttaagtcatcataccattttaatttttcgaaaattatttttccttttttattttcaaatataatattattttctgattcttttagatccattcctaattcatttaaccattgaataacttcaaaatcacattttttttctaacatctttaaaaatgtgatagaatttataaaccctaaaatttttcttagattagttctttttgattctcttacataatgtttatttttcatttttaaattccccctaatctttagctttcaagagccataatccatatatgtatttattattttgttttctcttaatagtacctataggtgtaaatattaatctaaatttcaaataaaaaatacaagcaaatgtcctttttataaggatatttgcttgtatttttttatttaattaattaaattttaatacatcccatgttactgttcactcttagagcatgggacttgtggagcatcccaaggtaactatatattcttgtataacgtagtaaattaatacttaagctagtcaaccgagcttaataggaatattcctacaagcctacgaatttattcgtgggttagttgactcttcatttataaacttttccacgtaacaccacacaacactcattttagtagttttaaatttcctaagtatcgtactaatggaaggtaaatttttattaatactaacttctggattggtaagttttctattacaagctttatattcttgtattaataaatttaatactttctcttttgtatatttttctttattttgtaaatcaatatcaaattttaatattttatttgcttctttttttaaagcatacatagaaccaaaacgaattataaatacatcagcattgtaaatatctttcgagttatctaattctccattgctagctaacctgcctagttttttgctaaattctatatacatttctaataattttttagtatctacttctactattacagagctttcattaggaggttcgaatccaatttcttttagtgcattattatagttacctaatactggttcaaatgatttagtgctgcaacagatttcttcaaatttatttgaactaggtatataccctaaatcatttacaacatcttttataatttttatccattcttctttggtccttcgttcatttataatttcatgtatccctgcaagtttttttagttcattccatgtttcattaaatctgtttctataataagtaaatgaaggtatatttgagctcttttctttttcaaattgagctttacttatagggtttattttataatattcttctttaaatatttttaataaatattcatctgtatattcatcatagggagatggtcggtctgatgttttaacatctaaaatatattctacaacctcgctccatttcattttgaatttttctctatatgtttttggatcaggaagattttcattatttgcaaacgtatttacagatggtattattttattttctttataccaatctttcattatttttattagctcatctttagtataacttttaggaatactaacttctaatcccagtttgcttaaggctttattccatttaccttctccaaatctttgagctattgcagagccatgaggtgatacttctcgtcgttttggtgtccttcctaactctttttgtttgtttaatacaatagtctttaaatattcatcagtgtatttatttttcattcaataccacctaatttctattttttcttattactattttagatgcgtcaaaactagccacaattcccctattgttttcagttatattcattttctggacccatctaaggatacagaaatttatatattttttaatcatagttatttatatatagaaatgtaacttaaactactataaatactatatattattaattgcactattccacttggatctaatcacttattcatctgtatatttatttcttctattttactttttaatgacttaatctttaatttattaattaattcatctataatgatgattgcacccaaaataatagcaattatcattgtattaaagaaacttttaccattcagaataagtataaataataataataaatcaaatagcaaaggtattaataaaaatctgaaattatatttttgcataaagctgatttctttagttaaagcaaaaccctcattcacatatatttcttttaatttcttttctattatctttgaatctacttccactcccatctcaattaattcttttataatatcttctttatttatcacttctatcacctctaattaataactatgtaagatatataaacataataggtataagtattattaatataactacaccagttataactttattcaaagccaattttgatttatatttactctgttcatctttagaacatttaattattttagtatgttttataatgttatagataattgctagaatagaaactatagaaataattaaaaatataagttttctatctccaagtagaaaaatatatatgaaacctactaatgcaacaatgcttaatggaaacattatcaaatttttaattatactattattattcagtgtactctcacctctcttatttttctattttaatattcactcttcctcaattctttcaagatcatgcatctaatatttgtattacaaattagttatattctcttaaaatacattcaacttctactatttttatatcagattcttctctcattacttttgtgtatggttgttcccaataccccaaaacttcttgttcagtattgaacctaattgcttctccgatgctgtcagtatcacctttcatatagtttgaatttaaaaatttaccattccttatcaatgtataaaaatactttttattcatttcaaacactcctttattacgcaatatattcaaattacgtactataataaacataaatactataattttaattaagtgactttgaaggtagccacttaaccttttatttttgtatataaacttctctaaaaaaaccttccctatcttgaatttgaccttcataaacactattttcttcagcaaatttaatttcttcaagtacatcatttttatatttttcaacttcttcttcagtatcaaaatatagcagtccagctatttcatcagtagaagtatattctattatggcttttattttttcttgttctgttaaatcgtcaaagtctattcctaaaatctcatcttctatacattctttcccaaactctttcttataccattctttcccgttttgtttataccattctgtaacattttcaatatacggaagttttaaagcttcttctaatgtatatgtatttatgtttttatcaaacggtgttttgtcctcaaatttttctcctttaaaaattctagcatcatgatatccacctacaaataatttcaattcatttttactcatttttacatatcccctttatattctatttggttgatttcctcaacctttaattatattaaactgcgtttaaacgtaagataaatggttttagaagatatttttacgattaatcgtatactatttttcgacatttattacccgcaccattcaatatttaatgactttctttagtataaaattatgaacgtatgattataaataaaatcatacattcatttattgaaaatttttaaggatatttatacgtcttttctataactataaatatctcttttatttattaatcaatctcaaattactttaaaatatatcatctaatttttgtgcatttaataaaagatctatcggcattggttcagaaaaacaattagaaacatttaatgttgatttattagttttataagcttcctcttcccctaattccataaaatcatttgattcaaggagaattcttacttcattttgataagaaaaattattgtctttaaatgtaggatttaaatttgaataattatcattcttagaatatttaacgaaaccacaaaatgccattgatatatttttatcttcaaaatagttttttaattcttgttgtagtttttcgtattttactaatataaaatgatcaccaaactgctttaatttctttgacggagtttcaattatatattctacattttcgtctgtctgcaaagaataaaaactcattaatctaagggaattaatatttacactattagatttatcaattccttcatttttatcacttatagcaccttttcctcttcccgaatacctttgataatacttcggtgattgaaaccacatatatccatttcttatattatttaaaatttcttttccgctaatcttaattattattgctttatgtggattacctacttcaagattaatttttttaaaccccttatttgagcattgagtacacacccctttatcaggtattttatcaaatatagataaacaccacatacaacaatatttatttttataacgtcctaattccatattaataaccccttttcatataaatatatattaatatgttaacatttttaaatttaattataaatattttctcttccacattttcacaatatacttgttttattttttctatagcttcttctaattaataagattcaactaagtatgttttagtttttttaacttgtattgttattctaatgaatgtatgatttcatctaaaatcatacattcattattgaaaatttttaaggatatttacacgttttttctataactataaatatcctctttttaatcttttatatttctcattatattaatctaaatgatcgtaatacacatgataataaaattatgattacaaaattaaaacttgcataagtatagactttattttttgtctgattctttaatttataaataagatctttatcttcatttaagtttaagcctaacattttaaacaaaaagaaagctatataatggagtataaatattactgatataaccataaatgatgatctcaatatttgatttatcattattgtattagataaaatattttttatctctacatttaacatatatctttcatatattatgtaagctactaatgatataataggtattaaaactatccctttacaataattaaaaatatcaattattcttggtgctggagttgttaatatatacattattggatttaacatctcttttttatttgtaattgtgctatatgaaaattcaactatatttactttattaagactaacatatctattatcctgttttattgaataactttctttattttcactttcataccactcctttattttattaaattcttctacagtagttgaaaatgaaatgtccatattgttaattagtttaaatactaaatgataccccttaactgtattatctttaatatgttctttaatattatttgttataaatgtactaaattttttcttcataatataaaagttctccttttcaaattatattatcttatatttcatatacaattaaattatctacctttaatgtaatttacattagaagtttttagtgcttttttaagctttcagatcttctaacttataatttggaatattacaacaactaataagcttaaaaataaaacttctctagtattaaaactacacattaatgggaaaaaacctttaggggtttttgccttttgtaataataatgctatgtttagacactctaatgcaattaccttacaatctgacaaagtacttatacctaaattcttcaatgaattatatttttcattagtaataatatctttaatatcagaaccctctttagtaaattcattcaatatataattttttaaattttttgatactttaatcacttcatcaatttcaaattctgaaggtttcaatattttggagtttcccattttatctatcttaataactaattttatacatgattgtacttccttataatatttatttgctttttttcttttaataaaataatttattatcgattgttttacattcataatataattatcctttctttgctcattatttaaattattaattttctatttaccgaatttaaatgatgaaatattatcgattcttatatgccattccttttcaaattctgttttataattaatatgatctttaatcctattagccagatttaataattcttcttcctttgttttttctcctatttccgataatgaaaacatatttctattaaaagaataaaagtagctttctatctcaacctttaaatttttatcatcaatcaaataatatgcttcacaaatcaatgaaaaaagcatattacgatataagttgttacgcttttttatataccgtttcccatttttagatccctttaccatatcatcacaaaaatgttttattaaataatcattatatatatctttaaatgaatataaaagattatcatgattatatactggagagtttattttaatattactttcttctaacgtagttaagttacttacccattggattttatcttttgttgaacttattcctaaaacatatctttttcccaattctgtaagcttatttattacacttttatattttctgttaccaaacactttatttcatcttctttctattgtaattaatcctatatcaattatatgttaattctaactaaataattggaacttaccttcttgaaattgcctgtatcatacatatataaagctaattcattaaaatctttattaaatttaacaacagccttatcccatgtacattttgacaattcttcgctagtatttaatatttctaattcaataccttctttaagagttaaatcagcttcaagtaaaacccattcatttgaatcaaaatctctacataggaatccttctttcctttgatgtatttcttgagaagtagtaacagtaaaatccatatccattgaatgttgaagctgttctttcatagagtctacttttattttattatttatttgaccacgctttgataaacgctagttcttatcttcataatcatcttgtaatgataatgaaaaaaacattaacattagtacaatcattgaaataatgattatttttatatgtttaaaaacaaatgcttgcattggctctttgaaaaaaatacatatcattattgatgtaataactaaactagctataaaaaaaacaaatttataccctttttcattaacaatctcacttggcagttgtattgttaatacataccatagaattattactaatataatacgtaaaatagacatttatttcgctccttcataatataatcatttttggattttcttcttgaaatatttattttaaaaaatgtaaactaattcgcctctaactttttgcttatagaatcctttaaagcataatattgcataacccacatttcatctattccaagatgcatggtatataattcgtttatatataaatcaatcttagataataagtcctttaatttctgaatacttaaatcttctactgataagatattttctactctatttctcctaccaatattagctatttttaataatggagctacctttaaagaatctatcatttctttatcttcttctgttaaaattatatttttattatctaccatatctctggcccctttcattttaaattttattcctgaatataatttttcagctgtgtactagcaaaccaccattaatctcatttgattacccttgatttcgtaatgtcttgccattcttgtacatttaatcatttgtccacctaatgctataatcatattttcaagcattgatttattacactttatccctatagtaatctttgtgtactcttcaccatctttattaaaaactcttgcttgatattgagttgctttcatattatctttcctttcttattctcataaaattttcaattcgcgcaatatctcttgtaatgtgacataaaaaaatactgcaccaattgaatagtgcagtataaaacttattatatttaattattaacaaaactttctataaattcatcccagggcaataatgggtattcttgtttaagcaatgccagtgtttctatccctattttggccttaccgcttttcatatcagatattagttgtctactcttgtttatttttctagctatttcagattgtgtgtcttttgttaagagtaaaatatcgttaaatgttaaaggttcatttttatagaatcctaaaatttgatttattactctccctggaatatcattttggtaatattccaatatttcatcaaacaaatttaatatattattaaattcttcttcttctaccaatcttgaaactgatatactgcatacatcaatatattgttttcttccaagtgtagggaaatagattcctatatctgttctatcaaattcatatatattacattttatatttttactttctaaaaatttaactaaatctccttttttaaagtaagtgtcgaccaaatcttgttttgggacacctaatattgtaaacccttttatttttttctttttcatcatttcaagcaataaattctttttaaaaactgccatctgattatcccccaatctatcttatttttaaagttgcagttcctatgccaccttttttacctaattctaaagttgcatttggataaatagctctaactttttcagcaaaatttaatatagttgcattagtagtttgttttgctgactttgcaagccctctataagtattacctaaattttcaactataccttccttttctaataattttaaaactgctttttgattttctcctaatctcataattcagtacctccaaaaggatatttatcttatatatctattgtacgatattatcgtacaaaatacaatagttttataagaaatttttttacaaatatttcgacaaaaataatatacaataagttttatactacactattcaattttcaaagaacaattttttattataataatttcatttcttgatcttatattttcattgcattttaatcttttatgttttcactacattttttaaatatatcaagtatttgtaatggtgctaaattttgattcatatatgaatctctaaacgcatatttgtaccatttgatttcaaatcctgtaggtttatatacaaagttaggcagttctgccttttctttatcatcatcccaacaataaggtcttactgtaaatacttcattatcgaaaccatcgaaatctcttgacacttcaggatctccatacaaaatactaatttttgcttttttacataaagcttcccattcccttgaattaaccaactgcctgtcagggaacttaaatgctcctcttgaattaccaaataataaatttcccaactccatttttttactccttcaggccgtattattttcaatttattggcctcaccaatatgatgtgtcgtctaattttcattgtatctattcttcatcctctggagtttgtttcatttcatttattaatactttaagctcgtttaaatctctgatatagcattcaaaactccttaactgaaagccctccgtttttcgtaagctccaattttcccatttagttatatcaatactttgaaatttactttttatgagttttgttattaagtctctattttttggtgtatctaataaaacatattctcttctatcttctttggcaaattcatatccttcctctatcatttgctccaaacgacttttttgttttttctcttctgtaactggccttgttgatgtaaaacttatatggcttgcatccaagcagaaacggcccttataaccgtagtttccaaatgcatcatctgttacaagattaaatccttgtttacgccaccatctgcataatgcatcatgcatagcatataataattctttcaatccatttacttgagtgttttcagctaatatttttttaagttcatgtatctttttatttgcctttcttatatctgcatatcttgatgctattttagctgaagcttgcgaatcaaattttaaaacttttgaagcttctgctgtatagctttcaataagattaaataatatattcttcatttcttcagttaattcattatttttcaactcattaaataattcacctgttgtattatatatatctgatagcctctttaaagctattgccttttcatcatcattgagagtaactaatttttctttttctatatccatgattttcccccttaagcttacttcataataatttcaattcctggatcttattcttgtattataaaacattattttagaatttcatcaatcggcatattgttaataggacattcatcaaattctattttctttgtatttccaatgataaaatctacatcaaaaaatgaatattttccgctttgatatgctagacactttttaataaatttaattaaatatacatcagaactagtataattcttagcgaaaccagaaatgtcagctgaattattattctcatgacttatatatggaaactgcctaaattcatgaaaaaatattgttcgttttccattgtatatatagtttgctaacttattaagctcaatttctaattctgaacaatctccaaactttttaatatgctttgcaatatctgtcatatgaaaactgtcatctggcataataccaaaagcatgaaatggtgtagattctatatttttcactaatttagtataggttcctcttttaaacattcagttttaccctcctcagttaatatatttgtactatgaagtaagtgtatttaagtcataattagatttaatgaacttaattgatttttctctgttgcagtcatttcctaaataagtgtaaatctccgccatttcatcaaatgtaaattcagtacctaaaaactcatttacaatagcccttattctcttttgccaatagtcactaatgcctttacagcttggtcttgataaccaagcaagtactttacatttcaattctaattcggtttctatatcctctaacctgaaataaatattattttttggttcaatgattaactcataattgtgatttataaaacatttaggtgaatatttatgaactatatttataaaacttttagttaattctacattcatagaaaaccattcctttcttaatgcacaataatttcatttctgactcttatatttgtaatgcgactataatctctcataaactttttgacttactgactttccgagaacatactctaccccttgttgtgtgagccagaaccatgttaagccattatcagcaatattatcactcattttagctaatccttttttgaccaaattattccaatcttcatcttttgattgtgtttcgtatctatttctataaggttttttcttataatctaaccctatacaatgcttaatcattctatcttgatattcagtagtttctataaataaatttttatataatcttttgaatgtttcttcctttgcttttgtaccaatcatagggtatctaccttgtatatactcaataccagcatggtcaatactttcgcttggtgcttcaaaaaaacttgtgttttcttttgttccaatgtaaagcgtaatgtaatatcctccatgtttgccattgcctttttccaatctcaatttattcactccttcataatataatcaggtcctgcaactgttttttgaattacgaactataattcttcatagactttatcactatataattatcttttctttacataataactacgccgaagtagtaatcagccgaatttaatatgatatgagtataatgtttatcatttaacggtattattttttttattttattttgttctaattctatattaagttgtgctacatcacttctatcacaataacctgcaatatcatatttatcttctcctacagaaagtattgatccatgtgaactaccaccacttatagaagatggtggcttcgtggtcaatactactactgtagcaagtttacccacgctctaaaggttgaaccaacctcagtgtattaccaaaattacatagctaatttcagtaaatttttactagcatttaagtctctatcatgttgcgtaccacattgagggcatatccattctctaagtgctagattctttacttctggatttttatacccacattctgaacatagttgagaactagcataattactaggtgctattattatttctctgccataccattcggccttatattctagcattcttctaaattcactccaactagcttcacttataacttttgctagtttgtgattctgttgcatgttcttaactttcaagtcctcaataactatagattggttttctctaattagtttaattgataacttatgtaagaaatctgctctttgatttactattttttcatgtaaattagctacttttaaccttgctttttttctgttattacttactttttgctttcttgataggtctttttgtaacttcttcaatcttttctcagactttctaagatgttttgggttaggttgtctatatccattagaacatattgcaaattctttaaggccaacgtccacaccaatttttttatttgttttaggtagttgaatattttcggtatcaactaaaattgatatgtaatacttcccactgggtacttgagatatagtacaactttttattaatccatttaattgtctatgttgttttattctaatcatagtttttaatttaggaactttaatatgcccattttctataaatatagtacccttctgattattagttgtataattgcgataattactcttcttacttttgaatttagggaatccaatagatttatctttgaaaaaatttttataagccttatttaaattgatttgagcatttgctaaagccaagctatccacttcttttaaccactcaaactcttttttatattgtgcaggagttgaatatttcacctttttaatatctaagtctttattttctttataggacttaattctatctgctaacatcttattatatataaatctagtgcatccaaaggtttttgcaaaatattgcttttgtttttcgttaggatataacctatatttatatgcttttaacattaacttttctccttgattttctatatgtttcttttatcgactaaagtcaagggctattcatctcccacataggaggatgggagaattacgccccttaagttaaacattatgttcagcttttcgtgcctcaaaaaattcctttttccaaaactcatctttttgtttttcaagttttttatctaatacgacctctacaggtgcatcaattaaattaaaatagttaatataggtattatccctagtgtctttaatccaatccattgtgatgatacatttgttattctcttgtaaagaaaaatctaataacgaataatacaccttgaatccttctttagtttctaattctattgtttttttacttaaatcatcaataatttctaataataaatttttctctttcttctgttcattcaaatctattatagctatattaaaaaaatcatctttttttataggtaaaataaaatctataagttcatttaatactttgttttgcatttttcctataagagaaagatctatatctatttcatttattgtagtatagatacatttctttttcctgctttttttaggtttggcacctttcaatattggaatataaacatctttaaatatagtatccttttgggccccttctagtactttaatatcgccaactatatacttattaccattaatattacttcttgaatttattttatttatttcacatttaatatttgatcctaattgaatatttagttctgcaacataattagataagattatttgtccttcttttatcatacttttcacatacctttcaaatctatttattacatatactaatctttttgaaatttttcacaataaaaaagtacgatttttttaaaacaaaataataaataaatacaaataaagattatggcttttaaaagctaaaataaggggaggatttaaaatgaatatgacttcattattaggcagaattgccactaatttcgaggtaaaacaagtaaacaatacgtcagttactaattttatattagcagttgacactacaagaaaaaataaagaaggaaatggatatgaatctgcatttcttcctatcgttatttttgggaaaaatgctgaaaatacttataaacatatggccaaaggtgactcagtttgcgttactggggaattacgaagccgggcgtataaaaaaaatggaacagatgtaatggttatagaagttatagctagacatatagaattcgttaaaagatccaaagcaaatcaacaacaattacaagatggttataataatcaacaacaatcacaaaatcaaggtggatataacaatcaacaactacaaaatcaaactggatataatcaaccaatacagccacaataccaaagctttaatagctttgatgataatttaataccaccaatagctgacggagatataccattttaaaaattaagaaataaaaaaattaattagtatataaaaatattgtgtaatacattcaaagttattacaccatattttttgtaaaatttaaggaggaaccagaaatgaacataaaagttaatggtggagaattcaaaaaatatataggattggcattaaaatctacagcatccagtgctgtcaatgccaatgatataattaatattagtaccgataatagtaaactaattatattatctggatcaagtgattttacattaaaacaagaattaagtaatgtaattatcacagaagaaggtaatataaatattagcgttaccatattaaatgctattattaaaaaaatgactaatgaagaaatatcattatttatagatcctaaaaataatgatgttttaaaaataaagcaaggtagaaataattcaaaaattgctcttgcaagagaacatactatatcagatattttgaagtctgatataatatatagtttaaatcttgatgcaaaagtatttaaaagcttaatagacactacttcttatgcagttgcacaagatgaagcaagacctatcctattaggccaatacattgaattagaaaagaatttaatcaaaattactgcactagatggatttagattagtttctaatagtgcaaaaatagaaaatcaacatgaagatatgatattaattcatgcaaataacctaagaaatctgtcatcattaattgatgacagcacagaagaggttatattaaataaaaataataataaaacaatagtagaagttaaaaataaaaactatgtagctattgctgcttctaatattttttcagaagagtttattgaatataagcagcttataggggacttgtcatcatttcctataaaaataaccgtagatagattacaattattaaatactgtagatagaatttctgtagtttctagtttcgttaaagaaggtactcatatcttaatgaaactaaataaagactcactagaaattgatggcaatagctctgttgcatcaatgaaaggtgaagtaaatattaaaaataacaattttgaagaagaatttacgataggatttaatcctaagtacattcttgatgctttaaaaaatataaacacaaaagaaatagatatgtttttcaatagcaatgtatctcctgctattataataaacaagccagaaaaagaagaaggtattgaaattaatgcattagttcttccagttaaaactattagttaaaatttcaataataaaaaatccaactatatttagtatagttggattttttattacaattctttctgcttttattgtatcttctaaatcttttttacctttgtcttctatattaacacttacttcagaagatgttctctttttgtctacattatctataatcttaacctttattttatgagcttctggagataaggttacttctccagtatattttacaaattctccattatctattttgtagaaaatttcttttataccactcaaactatcattaacatctataatcagtttattatcttttacatttatatttattaaaggcaattctttatttatcttatctactactatttccttagtttctttattagttagttcatcctctaaaataaatttataagtaccgttttcgcttacactgaacctctcacgactaaagtcgcaaggttcttaggtactatcaaaatttcttttggatagccgacaaatgctaaagcattgtcggttgacaccaaatactggtttggtttccctaagactttatcgagcaagatttccgttgaaatcattagcaccctacggggtttatcatatcggctcggttcaaaaccgtatgcccctaagtttaagtagtttaggttatagacctatgctacttaattgttttttatttaagcttttaattctttctatttctttattatgcaacttgaagaaattttcaaaagttacatttgctctatctatatctacttcttttaagttatcctttgtattcattattagaaatgcagaatacatatccctttgaatatttccttgctcaaatttgttccaacgttttgataatggctttttaacataagtttttgtaaaatgttcaaattgacttgctttaacttcataggtatctatttctttaattgaaaaaccttgatattgaagttttctatctataatagttataagcataccaggtgctttattaccaagcgatttaccaaatcttttcttacgattaatctttccagttttctcatttacagtagtttcttttgctcttttttgaagccctttaaaattcatagtttcaactctaacatcaagaccaagagaaagaatgtaatcagcaagtttattatgagattgttttctcttatctgcaattttcctttgaatttcacgaagcgctaactttgttttaatataacctttactttgaatccatttgtcatgatttccttttttgattgtgcctcctttgttatatttattagggttgtttgctctacgttgtctatcaagtttcctttgaagaactcttttagttctttcgtcaatgtttatatcttccccaagttctaatattttaacttctttttcacttgcgatagcaagggtagaagtaccaatatctaaacctacacgagaattttcatcagtagaaaccttacgattgttcttttgtggaggaacaccctcgaaagtaatttgaacaaaatatctatttttaccacggataacttttttaacaagtttacaaaactttaatttatctaaaaaacattgatttgcatactcgtcatttttctttataattactggcattgttagaccaagccattccattacgtttctatcttcaaaatatctaaaacctgttatatttcctttttcacgtacagaatggaactcgccataggctttaaatctaacttttttagcttctttaaacattaatttttcaaaagcactaaaagaacgttctgcgatttcttgaaccatttgagagcctaagttctttttaaacttttgccccataggttttacaaacttagttaggtcaaacttagttacaccaaagtctttcctaagtttattgaatattgcattacgttttttacccttttccattttcattgcaagaccatattctttttgtcttttcattaatctatatcttgaaagaatttctccaagacaagcattgtagatttggcgagcaatatttaatcttttttctaatatatcttcttgccacttttccgttttcagtggaagtgtcaaaacgtagtttgccactagaaaaattcctcctttacttatttgttcttactaaaacactctcttactaatgttataatttttttagacaatttttacaataaaaaactttaattatttttcttctatatctaagataatccataccttttatgtcaaattatattctttctttgtattttttcatattttcccttattataataatatagtataatttttcttgaaattcatacgaaaaatattttataagaaataataattaattatataaaaatatatggctaataaaagctaaaatttaaactaggaggagaaaataatatgttaagcaaaaaaactaaaaaacttataacatcagcaatattaagtttaacaatatctctatcatttttggggactagcataacagcaaaggcctttgatagcacaaaagctgtttacgaattaaaaaatgctagaacgtatgaatatacttggggttatgatatatctattaacagagatgttgattatgcaagaggtgaaatatatttagggtcaataagttctacagcacatcaattagatacaacaccatttagagctactatgaacggtgaacctctaaagatatttaatagcactaaaaattcattagaagcaaaagaaaaagaactactggctaaagaaatggataactcttctaataaaaacaaaacatttggaatttggcaacaagatttagatggaaactttagattatatgtgtatgttattaatgcaacttctggttttaacaaaacattaaaaataactaaggaatttatatctggtgatctagattatggattatataataaagatactaaagaatttagtgataaattaaaagaagttttaaattcttcatatgataaatcagatctattaaaaatttataaatatgatattgatccacgagatggaacaagcaaaattccttatcatgaaaaggaaatcatagatgaaactaaaagggttactaaagattgtacaaatgatatggaaaaagttcaggcaatatacaaatttgttgtgacacatatggagtatgttgaggaccctgcatataggaataagggtgccttgtcagccttaaaatctggcaaaggtgtgtgcgaagattatgcttctctatttatagctatgtgtcgagaagtaaatattcctgctagatatgtacatggactgactggcgctactggtaatcatggttgggcagaattttacttaccttattatggttggattatagccgaacctacagtatcaagcctaagaactgccaatgaaaatactttgcagaaggctatgatgagctttataggcacttatgatactaataatgattttataccttctcactctgtagcaggttataataataatgaagatagatatcacgctatctttgatagaataaaagtgactaatcaaaatagaataataaccataaaaggtgaacctataaaaagtgtagtatataatcaacctttttctaactatcaagaaaggatagattcagtaaataaattattagaaattgctaaaaatactgaaaaagaagaagatataaaggaagctagagaactagcgcaaactttaattgatagtgaagaaagagaaactatactaaaacaattagattatatcggtaaaagtgacgaattaaaatctcaaataggtgcacttgtagtggacctagaaaatagtgatacaataaatactaataaatttgaggaattaaaagaaatattaaacaatgcacctgaagaaattgtagaagaatttaaaacaccatattctaaaatagctaaaagatatgaaatagaaaatcttattaaagaaacagaaggaaatttaacagaagaaaatttagacaaactaagtaatcttcttgacaatgcaaatatagaggataaatataagcttagttatacatctaaatatgacaagcttcttaatgactacacaaaaaaagtagaagaacaagaacaaactgaatatgcagctaaattacaagctgctactaaagcagttgaaaaagctgaaaatagcaaaaatcaaactgatgttgataatgctagaggattagctaatagcttaaaagagatagataaatcaaatctaaatgctagattggataaagtacaaaaaaatatcgatgataaaaagactgaagaagaaaaacaagctgaatatgaagctaaggttcaaactgccacaaaagcagttgaaaaagctgaaaaaactactatatatgaagattatataagcgctacaaaattagtatcagaattgcagaattcagaaattcaaacacaattatgggatagactacgtgaagttaaagttgatataggtagaaaggaagaagctacagaactagtaaaattagttgaagaagataatacagaaacaaattacaacagagctttagaatctataaatagattaagagataatgaacttaagcaagatctactaaatagacttaataacgttaaatctaatatagataacaataatgcaaaaaaagaagaagttaataaattagtagcacaagcagaaaaagacaataaagaagaaacttataataaggctttagctgctgtacaatcactagaagatgatcaacttaagaaagaattattaactagacttaataatgttaaatctataatagataacaactctaaaaaagaggatgttactaaactagtagagcaggcggaaaaagataataaagaagaaacttacaataaagctttaactgctgtaaaggcattagaagatagccaaactaaaaaagatttattgaataggcttgataaagttaaagttaatatagataaaataaaaacaaatgaagcaatccacttggttgaatatgctgaaaaatatccttctataagtacttataataatgcaaaagatgcagttaattctataaatgatggcaatacaaaaacagagttattaaatagattgaaaaatgttgaaatcaaaatagaaaaactagatgaaaaaacaaaaacacatcaatttatagactatgtagataaattaattagagaagctgaaaaattatgcacagaagacgcttataaaaaggcattagaacaagcacagaaaatagaagatgttcaaagcagaaaagtttatattaatagattaaatgaagtaaaaaataatatagacataaataaagagacagaaacatctcctattaaaactgaattggataagctagagcatactataaacagtataaatactgtaaataaaaatgatatgcttgcaataaaagaaaaaataaatgatttaaaagatacaaaagaaagacaggatttaatagataaattaaataatatagaaaacaaatataataaattaattaataatcctaattataataaattaattaaatacaatacttggaataacattgtatataaagaatctaaagataaaacttttgctgttaaatttaataaaaatcttaattctaataacataagtgaaaatttatatctacttgatgttgataataactttgaaaaaatccacactactattaatataaaaggtgaaactgcttatattactgctgataaattatctccagggaaaaaatatatattagtagtttcagatcaaataaaagatagtagaaataaagatttaaaacaaggtttaaaaacatttatacaaattatagaatagaaataaaaggacttaggcatttttacatgtctaagtctttttttaaatataatattcttctataatattaataccttcttgtattttttaactaagatactacttttataaaattcgtaaacatatgctttagttcgattactttatgattcatattatacttacagtcatattcatgatgaatactattaatatgtttaattagtccacatttattttgaatatttatattttgattttgaatatcttctattttcttgacatttttatcaatttccatttccctaattataaaacctagcatataattcttaccataatatgaactataatgaggaggattcacaacaaatcttgaaattccatttataacatattcctcatttaattttttatttccatctaatcttttacattcaacaaaatatgcagcctttggattggaaaaccattcattttgacctactatttttatatcaaccctaccaatatatttagaatctttattattatagttttccggacactctggcataaaatgaaatttcatcatatcattattctttctattaattgtatcatctaaataacattctaataaatgatctcttaatctattttcattattctgaatcttattatcttcattttcaaaatttttactcattttatcacagcaccataaaatatattccccaattttctgaaaaacatcattctttaccaatgaattaagctttatatctccaaaccccgccatccttattcctccgaatcatctgaaataatagtttcaagaaccattgattgatcaatatgtgacatcgcagcatgccaattcttatattcattacttttaataataaagaaagaattattctcaaaatataaaacatcttttaatttataaaactgttcattaattttattaattagaaatcgtgataatatttctttattactatcaatagtatctataattgtaatttccttttcctcttgatcacatatttgaagttcaaatattgcaaacttcccaacaacttttggatataatgatattttaataaacttattttgttcagccataagctttttccagtaatccacaaaaacttttgaataatcttttagttcctctgctgtaacttcacgaaaagtcagctttttactgtttaaaagaggaatttgtacatttatagcataatcaataaacggatcttcctttaatccaaatttatctaatatcatctgatctagctggctgatatcttgacttatatcttgataaaaaccattttttagattagaatttttcttttgtattgcttctactttactactaatcccttcatcataagcaaatggatattcataaacttctttcataaatacctgttctctttcaatacccattgatgatccaagcattaagtttaaatatgcgtataatgatgaattaaacattcctgttatatttaacagtaaatccttttggcttttatcacctttaatcgcagaaatagcttccttaaaaataacatcttcttctgtatatgcagctcttaatctataatttttgcaattagggccttttcttaataaacaatatggtggagagaatatctcctttttacccaatctatatatttttcttttattaaaaatactactatttgaactattaaaatataatgtatcaatagcagtagattcaatcatgtttttcccaatgtaatccttagcgtcgtacttaccattagtatcagttattccagctccagtttttaatttatttttatttattacatcttcaattttaggaaattttcttttaagcattgttataatatctatatcccaactattaccataaacacatgtcttccatgcccaatcatacctatataatatatcttgctgaatattttttatatcggttttttcaattgcaataacatgataaattttaaaaaacatatttggtttcaaacttaagtgaagcattttatgacttaaacaattttccgttgaatttttaaacataagtattgctgctggtgcatcagcttttttaaatattaaacttctgacagatgataattccactatttgcagaatcttacacttaagtaacagcaattttctaaattcaattgcaggttttttttgattataaaacagcttagaaggaactatcaaacaacaaatagtatcttcattagaatactcttttacctttgcaataaaacttctacttatttcttgcctatattggggaatcttattttcatcacaatattgtgaatgtaacccttcctttacggagccccatggcggatttcctaaaataaactggaattttattttcttaagagctattaatttttcatcatcaaaaaaatcactaacccataaatttttgttctttaaatttggtagtctaaaatcatctaatgattttggatccttgtaatcaaataatgttaaatataatgaaaatattgtaacatcaattgcttctggattagaatccactccataaatgttcgattcaattaattgacaaagtttatcattgtcttttatatatccattatcatcaacatttttactaataataagttgtaaactttcaactaggaatataccagaaccacatgatggatcaagcactttacattgagaatctttagttaaaaatgtacctaaagattccttcacaatataatctgccaaatattcaggtgtataaaaagctttatcatcatcttgtgctttttctcctaataatacttcataaatattacttatcaattcaattggaataatattaaaatcatataaaggtaaaaatgataactgtcctgattccatttcttgatttcctgaaagaaaacactttaatagttcaaatacttcatcattaagtgcctcatcataaacttcatcttccaactcaaataagttaccattaaatttattctttaaatatgaaaaaaaactatatagctttcttttattattggctagtttcaacaaagcttcttgtgattctttgatatcaccattaaaaccatcataccctatatcaattcctctatctataagaaatcttataaatattaatctcaatattaattttgttgcaaattttactctatactgctttttcagtttttctgttatacactttatatttttaatcattacttgatttaaagtgtctttagaaaatgctatttgatattctcttaaaaattgctcatttgttatattccaatatgaaaatggtgacgcttcactacatttcttatgttcttcctccaatacaaactgtaacctaatattatcaagttcagataaatccatagaattaccattaaatacttttatactatcataatcattaaatattataataggaatttgagcattccatatttttttatataatttttgtttactatcattttcagatatataatcaaaaaaaagaactttaggctttccattgactacaaagaaagcacatggttttatttcatttaaaactttcttatcatgaaaagaaagatctttacacatattaatattagcaaaataatataaattcttcgaattatggtatcctaatttcttaataatcatctgagtagtattcgatattctattcaccatctcatctccttttgctaatttttattacttactgaaacttccacgcctaaagacatagaagttttagatactatataacttctatattatttctaaagtataatattactaatcatttttcctacaactttcaccatcaaataatcttatgattatattgacaataatatacaccttcactactttagtatatcccaaattcaggtgaaggtaaatctcaactttaattttttatactaaaaggtagcaagacttgtataatcttgctacctctctattatacttctggaactgtcgctgcttctctcaactctttaagttgtttctggaattgcaatatttcttttattatattttctttatttttagtggtgaagtctagctgatttgctttggatataagttcagccatttctttttcactggctaatatattgttcttttcagcattctctttatatttagttaatgtttcaatgacttctatataacctttagttttgtccattctgttcttatattgactattattatctaatctatttgttgctttttcagcctttttatacaggtcctttaattcatctagattatttattatatcagaataatttagatatgcatctagcttttctactgcatcccttgcttgtatcgctaaatccatttctgatattttattagttgtatctagtcgcctttgcaattctatttttatatctgaactttctaatttatctatagctacttgcgcttcttctattgttttaggatcttttgttgctatagcttttcttattaagctttctatatttcttattttattacgttcttcctgcttactttgattttctttacgatctatatatggctttaaagcatccaatactctttgcaattgagctttttcatttttatatatagttgtatttagatcatgaactgctttttttgcatattcataatcttctttatctaaagttgtctttgcttttttaacagcattataagctttaatataagcatccttttctgctttgatttgtttttccaaatcatctaatctatcagttagatcatctttatctttaccatccggcaatttagctaccttttctttagctctatctatatcatcttcatttttagtagtctcagccttttccactgcttttgttgcatcttctaaatcttttttatttttgtcttctacattaacatttacttcagaagatgtactattttggtcattcatatttcctgcattatctatagctttaacctttattttatgagcacctggagatagtgtaacttctccattatattttataaattctgcattatctattttatagagtacttcttttataccacttaggttatcactagcagctatggtcattttatcatctttaacatttatattagcaattggtaattctttatcaattttgtttattgatacttctttagtagtcttattgccagcctcatcttctactataaacttataagttccgtttttacttatagtaaaggttgttttatctccatttacaacttcaccgtcaggtagtgtaattgatttaacttttttattatctttagccgttacatttaatataatatctttattggtccaatctactaaattacctgttacttctaatgttggagcttctttatcgatgtcttcattgtctataataaattcatcactttgatcatttaaattccctgcattatccatagctctagcctctattgtgtgatgacctggagataaggtcacttctccagcatattttacaaattcaccatcatctattttgtagaaaatctcctttataccactcaaattatcattagcatctataatcattttattaccttttacatttatatttattacaggcaattctttatctattttatttactactacttctttagtactcttattacctgcttcatcctctacgataaatttataaataccattttcatttacaataaagtctgctttatcactatttactacttttccattaggcatagttattgatttaacacttatattatctttagccgttatgtttaatacaacattattattgatccattctgttggattacctgatacagctattgtaggtaattctttatctatgttacttatatctatttgtttactagtcttattacctgcattatcagtaacttctactatataagttccattattagatacagtatatttattacctgtaattacagtatcattaacttttatttctttaacaccacttaaagtatctttcgcatctatattaatgtctacattaccattagtagagcctgctatagaagttgataaatttaatgttggcaattctttatctattttatctactactatttctttagtagttttattacctgcttcatcctctgcagtaaatttataagtgccatttttagttactgtatagtctgctttatcactacttactgttttaccatctggcaaagttattgacttaactttgttattatccttagcagatacatttaatataatatctttattggtccaacttgttgtgtttcctgttacttctattgttggtgattctttatcatcaagttttatatgttcatgtttatctatatatttcactagtgtactagatttcaaatttaaagtaggacgaacgccatcaccaatcctattgaaattaatgtcacggtagttgctggtaccattactgtagacatagaacacatcgacgtcggtgcctgctggaagtgcttgaagagttagagtagttggaactctagtccaatatgtccattcataatccttatccccaaattttgctatccttgaagcattatcatgaaaagcattaaaactactaccaacaggttttgaattacaaacttttagtcctatttcctcaagagatggaataaatattttatcatcagtataatagtcttctttaccattaaaatttgtatttattaaatgtgtttctaatatatttgctttcagatctttacttaacttattataaaactctccatttaagtatgccctcaatgatgaattaccccaatggctactaggaagagatttagtatcaaaaggtcttttttctaatatatctttgctcatcacagttacagacccatctggatagccttcatgattcttagctactactacccaatcaatacctgatatattaaatatatcacctacaattaacttatttacttctactgtatctcccactttaatattatcagctgcaaaagccttattatcttttacaatacttaggctattatcttgcatacctatacttataggcatagctaatattgttcccaatgtggttactcctataagcgcttgtgttatcttcttgtttattacttttttatcatatggcttcatattatatcatacctccgaaatgtttaattaattttttattattacaattaattattatttaatatttaaaaaaccgtacttttttctaattaatttctaaaaaaatattgatatttagtttatatacgaagcctacaaaataaaaacattttatatctatatatttatatatacctatcttttagttagggtttaaaatttgtaccctattgaaaacataaaaaaaacactagatacttttatacctagtgtgttatacattactttaattgttacttttttatatcctcttttaacttttcaacttcttcaatagataagccagttttttttgctatcatttctactgaaagtatatccattaaattttttgctatttctatagctttacttttttccgcttgattcattgcttcttctttctctttttcaaaaatcttttctaccttagtcatccttaaccaactccttaccgtattagcatatttttcatcaataaacttatcagtagaagttaatacccctgctataatgaaatactgatttttttcatcctttacttctttagctaattctatggtatctttaataagttcatgtttatcctttatgcttttcattaaaggaagtaatattaaattcataagatctatatcttttaaatttatgccatttttaatcttttgctcaacttctttataaatagtatctccatcatagtttttcataaacactgattttacatctatacctacacttcctatattaaaatggtcctctgctctttcaatattacttgcatatattacagcaacatttatctttttaatagatttattctcttcataatacttccttgaaattcttaaaacataatcaatatatttatacatattttctgttattctattgttactttcatactctaacaaaagtattgagccatcttctaacaaaaaaatactatctgctctacgttcatctgcctttacttctggaaattcatttggaagcatttcaactattttaggataatctaatccatacataatcaatgctttatctttaaacatttcacttaaagttttaaaaagtacatctttagcctgataagttattcctttagttgacaaagcaccatctccttctaaatcaattatacaatatactattattattttctatataataaatattctagaattatatgtgttttcctctactccaaattcattaagagttaaaatttattacaagatctaaaaggacctgctaatatacaagcaggtccttctataaatacaaattagaatcctatattataataagtttgggcacccttgaatcctaaatcgttagttaatttttcattatggtgcaaattagtagcattgaatccgttaacaggtaccttaatctcagctttacatggtatttgtactagctttcttattgtttgctttgtacctttctcttcatctagggtataggttctagagacataggcctcagcaataaagctaatagttaagagcggattatctccagcataatcaaatttaaatatgcatgttccaccattttggtctagtttgcaataatatggagaagtataatgtcttccattaccaccaaatctgtctaatctatgatttactgaccatttttttatagtagctcttactccatctatatataccggacttaaagatatattcatggtatactctgtttctttacctttttcgtccaggtgatatctggtgaatgggaatttagcatcagtatttattatcatatgtgctgatccgctgctgcttccgccactaccattgcttcccatattaggagtaaaacctgttgttttatattcccatctataacgctttacttgcctttctttttgcacacgtcttgtttttgttatattctttttagattctacttgtatccctaatctcatgtaaatcaattgatctctttgaccaccaccatcaccaataacactaacatctgttacatcatattttgtgaaattataattgctaaatatatttttaatttgtggcaatgcttcttctgcataacttttattcccgcttatatgaatcggataacgagtttcagtccaaatccaactaaatccactgactgatacagtatattcttctgtagtccaatatttctcagtagtccaataacctactctttccatatggcttgtatctatataaggtggttgtttattactatttttataatcataaacactcgctgcagatacaaaactcgattgaattattaatataataaaggatagtataatgattaataatctatttcctttcatactttcacttccttacatgcttttatatgattattattccaaaaaaataaaaacaactattttgacttttaatagttgtttttatttgaatatttttatttgattatacaataagtttctattaaataaggggaatttttttccggattatcaggatacctaactgcaattagtaaatcttttggtaaacttgtaggatcaaaactaatacattgctcacctccatcttcccctttcaatgaacttgcatcaaaaactgaacaatcattataatttaaatactgtccattatctaactttattccattattatcagaataaacaacttttgcaattagtgtattctttttaaataaaacatcttgtacatgaaatggttttttataatcaattaacatatatgaataaggatttgttctcattaaaatagcatttttaattaaatcttcttcccatatattaattgactgatatttagtattatcttgtatccctactctattaagcttaggttctaagaaattaagtttcttgcctcctaacattggatgcctatctccaaatggatttgcactaaaatctcctttataaacaattacttcatgcccattaatccattgaacttcttttgtaaatttattagctggatttttttgagcttcaggtatatagctagagtcaaatccgtatttaaaatactttattgtgtaatccttcttcttattaagtaaacttacaaggtcgtccattttattcatagttttaataaagtatatttgtgaagaataaggtaacattgttttaatcttattcttattaacacgaataccatctataataacaattaataataccactgaaattaatctagttaatttctttctattcaccaatgtgcctcctttctacagtcaatctagatatactttaaaataatactgctattttttgaataccctttatttcattatcttctttagatattttaattaaagtattttgaggataatattttggtgtataatatgatgctccatcatatgattgatctaatctctcattaacaaatgatagaggaatactatcttttttaatattgaaatattggccattatctagctttataccattttcatctgcagatataactttagcataagttgtggtgcaaacagtattagaacttttcactttatcttcaacagtaaaaggacttttatatttgataaaaaaatacatataatcagatccacctaaagttgatttttgcctaaaagcatacacatctttaaaaaccttttgatttttagctgttaggaattgtacatttaagtccatatattctttaccactaattttttctttatcaggagaaaatattgtttgagctgtaaggatctctgtatttgctacatctaatattttttcattattaacatgaattactgttttgtctttagtataatcaactctagcatctcctttataaacagttatatcgtctttgtatactttttgtgtttctttactaggtttttgattttctttattctcttctactttttcttgtgtattttgaacagcttttgtatctttggatttattaaccccaaccgctattccacctactataactacacaagcaataattattgctgttatcttctttttattcatctaaattacctccaaattatgtttgtatttatatattatttctatttttagcaatgtttatatttatatgataagttaaaagtattctatacacaacaaaaaacctaacttatatattttaaaaataagttaggttttttattgtgttttaacttttttcgcttagtatagtagtataacaacgctagtgaatacaaatgcgataattatttagaaaggaagtgtgattatatgttgtatataatacctattatattattaattctcacagcatattattataagaaatatgacatacctaagatagacttagctagagtaaaaacagttaaagatattagatattttttaactatagctactattttttcaacaatatcaactatgacatatattatctaaaaaaccatctcaacataattttgaaattatgctgagatggttttttaaattcctactttataaaataatcgtatctttacatacatactacatataatattagtaaagaatatgcccattttattataaatttaacaaaaactagacctaagaattatagagccatagaaatccctatgaatactgcagaaaatactaaccacgctccagctgacataatacttcactcccaaatttaaattttatttttattattacctaaatttaaaatattattcaggaggttttaaatgagagaacttttaaaagttatatgcttctttataggaatttatggaattgtaaaaatgtggtgtaaaataattaaagatattaggaggaatgtttaatgttgataaatttatctaaaccaagattgtacttacaagataaattagatgaagccatatttaattataaaatgaataatgctatttcaaaacaacaaaagattaaaacatttgtagatacaacagcaactacattaactgttaccttgttattcactacaccagttagtgcagtaggttttgataaaataacaggagccttaaacccacttattgacttgattcaagccttaggatatccattagctgtattatcaatgagtggtggtgccataactatgatgttcaataagcgaatgggagtaagaataataaaagatactgcagttgcatatttagttctacaatttgtaccaggactaatgaagatattaatggatataggaaaagcaataagatgattattgaagttattccagacataaatataaataattctaaactatctagctttcttacaaatatacattcatataaaaatctatttaatagaattaatcttaaagaaaagaaaataacacatcaagataaaattatatatgaaattttactaactaaagaaaacatatctttttattatataatcccagatagcttaaaagaattagtacttaacgaattaaatgtatgttacccaaaggctacatttaaatctaagaatacttatagaacatataaagaagaaggcatacttaattttataaaagaggaccatatgatagatgtccatgttgcagatgaacttgaattagatcaacatagttttttaagtttaaaaacagatttgagatcagaatatcctcttaattcattattggaaacttctaaaattctaagagatgatgaaaaagtgttaatgcaatatatattggtacctgaagatccttctctaaatttagactttgaagaagccattaaagaattcaacactgaaaaaaagattaagagtaaatacaaattagataaagaaagaataataaaaggtggacttaaactagcttatgaatgtgttgctgaagtcatggatttagctagtttattttttacaaatgaagaatttgaaagaattgatttagatgaattagataataatgtgctcgttcgaaatggattatctcaacaaaccaaagacaaaacttcttctgtttattatgatacatctataagaatagctactaatagccaaagaagtgaattactattaaaattatttaaaagaagtttcaatttattagagggtgataataagttagttactagaaaattaaagcaaaatgaacttatagaagcaataaaacaacgaaagcctatagataaaattaatatggatgcattaagcactaaagaattagcacaacttatgcaattacctacaaaacattatcaacaagaatataaaattaaaaatatagatactagagaaattaatatatcacatgcttttacatcgaaaggattgcaaataggccatactaaatacaaaggtaataaaataccattattctttccactggatgatttagattctctatgccaatgttggatttctataggcaagatggggagcggtaaaactacttgcggacaaaatactgcaatacagctacttcaaaatggaattagtgtatttgctatagatgtagcagatggtgacttaatagataacatagagaaaggcttaccaaaagattttaataaaattatagatttagatttcggagatatagataatcctatacccttaacatggagtgaatgtgctaatggagataaaaatgtagaaaccaagttagcttctcaacttaaaaactttcttaataaattggccaaaagtgataatcaaaaattaagtagtagaatggaaaggtttctaggtgctgctgccaaggctgtatttaaaaatccgactgctaatctatatgatgttattctctgtcttactgatagggaatatagagataatttaattgtaactaataatattaatggtagattaaaatggaccttagagcaattaaatgatgatggaaatgaaaccggtacaaaacaaaactatgtatctggaataatggataggttagaatctttactggataatgagtttgcagctaactgtttattacaagaagctaatttagatatagactttaggaaatgggcagatgagggttactttgtaggcataagaattcctaaggatactttattagatgataccacagacttattagttacttatatagtaagtaaattatggcttgctatattaactagaagtaatatacctaaagagcaaagaaagccttgcattctaattttagatgaacctcatcaatttcctacagtacttacagagctgcactcaattataagagaaatgaggaaatggaggtttggcatatttatattagcacatgagtttggagattttaaaaatatgaaaacattgcttaagagtgcaggcaccaattattttatatatcaaacttctaaagaaacatataaagaattattggaagaacttcagccatttacactcgaagaaatgattaatactaaatggaggcatgctattgttaatatgagatataaagaagaaaagatttgtgttatgacagatatgttaaagcctttgccacataaaagaacatataaaaatagaaatgtttttggtagatctgcagaaaaagtccaggatgaaatatttaaaaaatctatgcattttgaagatgaatttataaataatatgaatgatgataaagaaaaagaagaaaatgttcaacaaaaagctattatttaagattaattaacctatagaataaggtatagaacaacctatagaatagatgtagaatagatgtagaattttaaaaatacaaaagagcttataaatggcttgaaataaacattttacacaagattataaattgataaacccttatatatattatatatagttaaaaaagggtaggtgatgtattttgattttgtcggagcgggattggaaatttttaaaggacttatatttcgtaaaaatcttaaatactaaaagaatatgtagattatataattcacaaaaatattgttatgcacgtctaaaacttttgaaagataataattatatcaaaattttatataagcttcctaataaagaaaatgtttttactttagataaagaagggtataaaattttaggttataagccaataaaaattaatgctagtccacaaaaattattaccattagctgacttttatttttatgagaaaagattggatccatttattaaatttgataacaaatattattttagttatggaaatagaaaatatattttaaaaatagatgtgctcttaaaaactaatacatgggtatttgcaatattaaataataaacatctagaagagcaaataaaaaaaatagaaatgtattataaaagtaatcaatataaaaatttatttgatagattccctatagttgttataataggtgatactacaaataaaattactgaaaataaaaatattaattgccaatggttagaatatgaaaaggttaaagaatgggactataaatattaacagtatatttatagtttgttacttattaatttttacaataaacatctcagtatatgttaggatcatactgagatgttgacttattaaattctattttaattaatatttcaattgctaaatagaaccttatataatagtatcattaagggcctaatgtatttataatatttttgcactattctaaaaccaatttaaaatttattaaaattgaataatttccatattataaataactttaaatagctatctcattttaatcagaaaaatatcttgataaaaagttagacttcctttttttttaaatttggataataattgatcatatttttgataaaaactattactaattttataaataaaagatttcccttttacctctgctattttttctaaagattcttctactatattatctaaatcattatctttagaagataatgtaaactgttgctcgtttataactagcttatatttatattctttatagcttgtactaatatttttaaagtatttcttaaatattttccaggagttttttaaggcaatagaaatattacatttagattttctcacaattttccatgctttattcattacgtctccagcacagcttaattgccaatagcctaaatctatttttaacataaaactatcgccccttataatttattaatagcaggaattaatttccaactatttacatatattatatatgaagcttaattttatttcaagatattaaaaatattttatatataaattaacatcagttcccaatttagcgaactgatgttaatttatgaatattatcttttaagtaaattataaatatccttttcatttaaattaaatattctttttacttcctccccacatttaatcatatcttggaaacttttatatttaatacttaattttgaattatcttttaatgagatgttttttaccatagttgaatctacctacctcttataataataaagaaaatcaaattgttctatatatgttaccattcatcactcttactacggaatattcatattaaaacctttataaattatatatattagttcatttattatattctttatatttttctgcaagctcttctttgtaccaatctgcaaagcaatcccctttctcatctttatctattgtatctaatggagttagttttatcggctttatattatcaataccaaaaaatttctccatagtgttggtacttgctttatccattattttttcaccccatcatctttcttatattttcctctcatttcgttacatatctcatcttcctctggagtagattgatagtttttatcataataatcatagacttcttttctcttttttgaatcaaaaatcatatctagtaaagaacaagattttaaaagttctttacctctagctaactttgcttctacatctatatcctcaatttctattttatcatcatcaccttcttcaaaaaacatatctaagtatctatcatcatcgtataataactcttctttaatcttcattctttcttcctttgttagggtttcttttggttttatttcttttttataatcaaaaatattaataactttactcataattatcactccatttttacgaatcagctaatttctttaacgctttagcatatttcttattgcacttttttattgctaaaagcacatctttagtatttgccactttataatttgtttctgtcttcctttcctctatttgcttactttttttgagatagtactttttcttattaccattccatctttttatattcacaacttttctcctaagattttcaaattatttcaaattatttttgcatggttttttatataaattagcgattcttttacatgcatctaaatcttctttagtcaaacttggagtttccaactttttaactatactattgaaatcaccttttgacactgtaaattcaaatatattattgcttctataaacttttgtcatgaccttatctcctcacattctgtgaaatagttatataaagacttttcatttattggttttacaaatcttagaaatacgtctcttccttcttcatattcttcttgagaaagggtgcttttagctacttttgtattaaaaaaagattgtttgttcttattcttttttcttataaattctaatgttaccatagaaactctctccctttttcattactatgtctattttaagcttatttcaagataattcccttccttctgaaatactaatatattattaattattatacaaggaaactgaatttaaaacgtcttttcaaggtgattttatatttaacttgtataagttgccgttctataggcatttctatataagcatctatcttttcttttagttctttataattattatttcaaaataaaaaacatagtatattaaaaaaacatactatgttaagaaaattactattaattgtagttctatatttgaattacattacaactatttttagattttcttctatatcaaattttttctttttttattaaatcgtctcttaacctagttaatactattcctaaccagttagtacctagccactgattactgtcccaagctctaggatcttcttcagaaaggccaattccccatatcttatcataaggacttgtttctacaagaataagtcctttagcctctattagatactttttcaatgcaggattttgattaaacttataataatttcctttgtatactattctttttaagttttttaaattttccatctccaatatattctttaattttttttctaagtttttgttcatcttgtatttttaaaatattggtaaactttgttttttctgcgtctaaccataaataccaaatatatttcgaaaaaccatagctatcataataaaactcaaaagtatatattttcttgctatacctatcttttattttaatctcaagttttgggttaatacaatagcctattatcccatcaaaatttgttaatccttttccctcaattttgctaaaattaataatttcatatcctttagggcaaatctcttcaaaaagaatttgaatattcctttctatttccataaaacacttctcctattttacatattattaatcataatcttcagcaaggtttacttcgtcactatctgtaattctaataaccttatcttcttctattttactatagactttagcatagattatagccacatcttctatactggcaccatgaatacaaagacttcctattacttctccaatacatatttcatttgcatgatattcctcaataatggcatctactatatcatcaatttcagacttacaatcaatagtagttccttcatataatctttctataaatactttatttgtcaacatttttcattcctccaatttttagctctaaaataaagccataatttatgttctaaatagttattattactttttaaaaacttataaagaacttaaggttaactttatatgcaaaatatacaaaaaaattaacaccagctccctaattcagtaaactgatgttaaagtgtagatttcatctaatcaatattcttattttaaaaacatacaaggtcgagtttgtatgagattctcaaaatgctctaaattcccttttgttaagtttttttcatttatataaaagttctcattattcatattatcaaacatggacatttgattattttgtttttttattttataattcattcccatagcatataaatccttagctaatcctttattaaacattaaaaactcatattgctttggactaaaggcctttagccattttagataatttctcttggcatttaataaacagcaccaacatccagttctaggttcatatataacttttccatcatcatctaacaatttcttatcatatatttcgttatatggaatatttttttctttgacataatcaattaccatactattggtccaaaataaaattggattaactctaaataagttccaactactagcaaaatagaataccccatctcgtttaccagcgttaagcctagcacgagattcatcagctctaactcctgcaacatccgaatcatatttccgttctgtaattaaattatgcattggtaaatgcttaataaaatagcagcattgttcactagcactaacctttttaccagttgtcttatttatagttctatcccccttatcttgaaaattccatccattctccttttgtaattcccaataagtttttgccggaagtgtctcaactacattagttagatcccactcttttattatctcatttttaaattttatagtatcattatattctactaaagaattgttaaatacaatatcatagttatcttttttcacttttcttaaaagatatagtgatagtatgctatccattccaaaagaacaacttaaagctaaatttttactaagtcttaatgtttttttcattatataaagactttgtaattcagctaatttaattgttattttagttcttctttctaattgtctatctttatgagctaaattttttattaactgcaatccatgtgtagaaagttcttttctaggatataaccctcttattgcacttatgtctttatttcttaccttctcttttcctgctaatattatttttatatcttccgataatccaataacaaaatcttgtagttcttgtggactttctggtatagttaaaattttgttatatatttctttttttactctttttttattctctattccattaattttaattattatattaatttctttatcagataattttttgattataaaattattttgttttattaaattctcttttaaaacattaaattgatttaaatatttttcccttataattttttcgtttgacatacctaacgactgcaattcaatataattaagcaagtctatacctttaagttttggattctttttaattttattatattgtttatatctatacactatcccttcgtactcaaaagtatctggggtaaaaacacaagggtttttaccataataatttaattgattatcttctaattttaaatcatcttcataataagcaaaaatatcatacatctctggaggttgaacagtatgtctaactccatattcagtatcttcttcaaacatagttcctattatgtcctctatttgtactatagggaattcttcttgatttttaagcgcatttacaatattatttttattaaagtcacacatatcttcttcctcgcaaccatagacactacaccaaatatcctctttttgatattgttttaagagtattgtcgcaagcatttctaatattattccattttgattataatttttatatttcactttttgttttagctttattacattattaggatattgattttttattaaataaaatattaaattcagctcttttttatcctttatggaagataaaaaattatagcactcatcataagtaccactaatccaataagtacacatatggtaatcattatccatttcacacatttctaatatcatttctccctcggttgttagatcatttatactatcaattataagatcatctaaccttctcttaactttttctaataaacaattggcaccttgcttattttctttaaatttaattacttctgctaacattaatagttttcccccttattttagctttaagccattaatatttctatacccagttattattccaaaataaaaacagtaaaaattattgatatatcttcaaataatttttactgtctattgttttaatatcttttatattttctaattctttagctttgggccattatttaaaatttaactctgtatcatattctggatcatattgtggcattaatattgcacataataaatataaaattcctcctatgcctcttaacaatatagcagcacaccatattaacctaagcgttgtagcatctatctctaaatattctgctattcctccacatactccataaattcttttattatttgttttcataaattttttcttcattataaactccccctctaatctattagcttatttgaaagccatatttaccatatagttagttattattactttttaaaaaaatagaaaaactatcttaatataaaactaagatagttctttatgtttaaataaaactaaacatatttaattgttcaaaaatagcttttgaatctactttcttgctattcacatactcattaatattgcaaactttacctggaaatctcaattctttttctgattctaaagataaaattctttcttcagtttttcttacagttactattctagtatttacacctgtagatctatcactttctaaaaaacttccagaaggcagttttttagagaaactttcttcctgattttctaaccattctctaaatttttgtgacttcttatcagatgcaaaaaaaggatgctcactcataatagcaactacttttccacctggttttaacaaagaaaatgcatgtaatacatgttctatatcttgatttctttcaaatggaggattcattattattttgtcatattcttctactattatagaatcattattatcattttcttttaaattcacacttaagaagtcatcagctattacattatgccctttcttttctaaaatttgggataaagaataattaaattctactacatctaatttattatctggatatttttctctaatcaaatctgctatatgtccactccctgctgatggctcaagaattatatcattttcttttatatcagcatgctggagcatttcccctactatattctgaggagtaggaaaatatcctggtattttaactcctataatacttctttgcatttctttaatttcttttttctttctatcttcttctgtttcttcaaaaatttcttctctactattatagtactctcttaaagctgctctaagcattacagtatcttttatatctatcgcttgaagccttttataattatctatatcagaagtattaaaatattcaaactgaccattttgtttacctcttgaatacaaatctattatatcttctgtataatttttagtattaatttcagatgcatcattctttaataatttatttagtcttcttcttatcattactgtgttacttacagtagtagtatcttcaataagtcttttaatgaaatttttactacaagtagttaatggatattctgctacatctattgaatcaaataaaatatttgaagaatttctcaactccttttcatattgtatagctttattagaagagagattttcatttggatatttttctttaacttttatacttatatattttcttttacaacctttaagtatatcttctaaagtttgaatatgagttctagcagatatcttatctaaatatttagcttttccactttctataatatcagcaacattatacattatagattgtatattttttaaatactctccttctctttcagcattagcagccatattagcacgcctcgctgtatttgtaagcctatcagcaagcttattatctatttccttttgcatattgtctgctactttttttaatttttctgctgctttatcattctgatttacttccttagttccttctgttttaaatatatcttttagcttttctgaaggatcaaaataaaaattgaaacccctagtaaatctagaatagcctgctccaccaaggtttttcatttgtctattaagtgatttaaaatcatcacttttttcctcaaattttacaacccataaatctctattatctcttgtatcttttgttttttttattgaataagttccattggaaataaccttttgagttaatttaacttcttgttcttttagcttttctttttcttctgaagcttttaattcctcataagttctctgttcttctatagctagctttctcattcttctagcactttcaaaatcttgcaatgtttcaggattttttatactttcttttaatctcttaattttttccctgtacgcttcatatttttcttttcgtccttttaatagatcttttaatctttcttctgttaattgaacaaaagccatgtttattttattagacatttgttgtttaattgaagaagcattgaaatctatagtaatcattatagaatcttcgcctgaaataaaataataaatattgtctacttgcgagctatatatatgatctacaatctcgtctttcctagtatatctagaatcactaatcatttttttaagttctgatacttttaattttcttaaattctctttaataatattttcattgtttaaaatatactgaatcatgtctttaacataatccaatgtcatatcttctccttttccaaacttatcattaaaatcacttatttcttctaatgaatacattattattttcccccttaaattttagctgtaatttagccataaactattgtttaactaattattattactttactaaactctttaagggaaatatgaaatcatacaaaataaattatccattacttgatactagtaaatagtatataatatacatatagacattaatccttctatttcattttaaatacacaaaagaaaaaagtagcaagactatttaatttaagtcttgctacttttttataatcttatattatttttagcttcatattctgcccaacatttaataaatctgttagggctctggattttattttttaaataatctttaaatccttcctttaaaggcttcatttctttctcatagacatctgaatttatataattccagatatctaaatatataacatcatatttatcattttcagacttccatttaaatatgtctgcattaataattttaactttactatttaaaggtaattgctttgctattagatcaataacatcgctacttttttctataactgttatagatttaacttcttttttattttgaatagctaaaactattaatcctattcctaatcctgctataagtatatctccatgggcatgttgaacaaaataagcatttgtccttttttccataggagtattagacattactacttctcctttgcatgttaatgtaacatattctccctgaggtataccttctaacatagctctaatattattttttgatatagtaaatttatttatagcataatcttcttttattccttcttttaatatattacttaaattttcaaaatacattcttccttctccccaatatttaaattatgatatataatattttccttaatattttatcttaatgcaacattatattgatttatatgtttttttattatttttgcaatatatctgaacataggtagcggtatcgaattgcatacttgctgttgtttttctgctaaattaccataaaatataaaatcatcatctataccttgaagccttgcacactctcttacagaaataattctatcttcagtaggatgtaaaataacagactttctaggattcactatagttacagatggtctgtttaaatctaatcttacataactattagaatgagtacttctgggccttaattgatcaggaatatcaaaaacattccctcccataggaatataagacattcgtctttttactatgtctttagatttactataatctaattggttagcaattttattagttaaccctttaaaagcatttttcaccgtattggtgaaccttttaataggattaaatatatttatttttcctattttagatcctataattacagcccttcttctttcttgtgcaacaccaaaatgtactgcatttaatatagttgatgttatttcataatcataaagttcattttttatctcttctaaaaatttacctttacctgcacttatgatttgtggtacattttctagcacaaaaatatacggttgtgaagattttactgctttaatatattccctaactaacaaatttttaggattgtccaaataattacttaccctattactattcgaaaagccttgacaagggctaccacctattaaaaccgttgcatgtggtatattattcgataccttacttatatcctcatgtaggatatgacttcctaaattttttccataagtttcacaggcagctctatcattatctaatgcaaaaattatatcaaaatcatcaagaaatgatttatccatcaatccagctccactaaatatagaacatactgttaaaggcaatatagaactacttaaagcattattaaacattgtagtgttaatattagaactatttgttgaagcagttatattaatactacctatactatctaaaaagcttagttgatcattacctgcagctaaatttaaattatctaatatagtttttttagataattgtattattctatttgttttctttattatttcttctttactacaatataattgtttctcttttgcatattcttctattgtaattttattcttatctatttttagttctaaataattactcttaaatatagcaattgcttctttacttcttatatctattacaggctttatagtatctttatactttcttctggatatagtattatttgtcttagtattgctaggtactataactaacttatgattttctatgtctattaaatatttaaaatttttgcctgcattaaatagagtatttattaattctttatcttggatataaatgcctctttgtgattttttcataattctcctttttatcaatttaaattcctcctaattttagcttataaagccattaatattatttaaataattattatttcgaaaaaataaaagtacattatgttgaacataatgtactttgctgtatttttagtttattccctaccatttcatatcaatattcaatatatctttcacatttgctgctatatttagaattattccattcatcagagcatacattacatgaatagcaatcatttggactcccttcatgaataattgctcttaaacatgaatgacatcggcaattttcacatcctacacccattgtattttcttcctctaatagattattatccatttcttttccacctttcttttttagctataagccattattattctatatacaattattatttcaaaaaaaactttaggaacatttaaataaaatattcctaaagctttttgcgcttacatatctttattttttataatatcgccaatagctgcaatgtttcccaatgaagataatgtttcatttggaagtattaatttattagctggacccttggccatttcttttaatgcttctacttgttttaatgcaataactgtttcgttagttcctgattctattatagaagcattaacatttcttatagcatctgcttctgctttagctatttgtgctattgcttttgccttaccttcagcttctaataattgagattctcttaatccttctgctctccttatattagcttctttctctgcttcggcatttaaaatagcagattcttttaacccttctgctttatatatagcagcttgtttttcaccttctgattgtagtatcatagcccttttatctctttcagcttttaattgtttttccatagatgctaagatatcacgtggtggcactattcccttaacttctacactaaacacttttataccatatgcatctgttacctcatctataatagctaataattttttatttatttcttctctaccagttgataatatctcatccaaggtcatatttccaacaatatttctcatatttgttatagatgaatatactatcccggcttgataattttctatattatatactgctgctttaggatctaatatcttataaaaaattacattatctatagatatattaacattgtcttttgttataacgctttgaggctctatatccaatatctgctgcttagtagatattctttgcctaacaaaatcaacatatggtattataatatgccatcctggttctaatgttctatgatactttcctagtctttccacaacatatacgtaacctgtatttactatctttattgatgctattattgttgttatcaataaaaataaaataaaaattataaataaaaccttcatataaaaaacctcctgtttatcttatagtaattatatatacaatttttctttttttaatttttatttgtaaaataaaaaagaattgggattttttcaattccaattcttaaaggttctttataatttaaaattagttgtattgcgaattaatgcaatactattaattgtattataatattctttttcactattaaagctttccatagcagatacttctgatatatcagctcttattgaatacccacatatggggcatactttagaaaatattattttgttactacttttatcttctttacttctaacagctagtttttctccgcaatgtttacaaaaatctctatttttcatttctttatttcccccttaaattttagcaaatgtccatacatatatgtatatatttattattcttaattttgaaatctaatgcataagagcattaaatttttgttttttatattcttttactatttttggctccttttctatgtatttatatacagaaaaacttggattaatagtatttctgtaattttctctttccaaagttatatttattttctcctccaaaaaaggtatattacattctttgtaatacgccatgaataatttttctctatttaaaaaagagaacttaggttttatttctaaaacacatcctaggtattttgtttgctgattttttataaatgaatatttttctgttacatttccattttctacacaatataaattaagaactacattatacaaacatcctttgtgttctaatttttgctttaaatgaaaatattgttttatgtcttcttttgttaaataaaacaatacataagcatttcctatgtattttccttttctatttttatgtgaagaacaactagccaccgttggaaaatagttattaatataattaaccaatggttctatagctggatccagtttcaaataatcttctgtatatagactattttttttattaaccatgtttactaactccatatttatcatttaaaattccccctaatttttagctttaaaaagccataatttatcatctgatagattattattactttttttatatgttatattgtataaatagcaaaattaacctattatatagataaaatcccctttaatttttataaaatataaaaaaagaaaaggtagaaagactttgaacacatagtcttcctacctttttcttttaactatattaataatattatttaataaaagcttaatttttttattatctattaaatataatgttttaaaatctgaaaaaatgtatatttttataacatgtcctttatcatttaaaattttaaaaccataaattacttatttttttattgtacaatctaataaaaaaatttattataccagcataaatatatgaaaggagtaagttgagaactattgtatttttctcaacagtgatagacatgttatcttattacgaattattattagaaattaaattaaataaggatatacattttagtaagtcttatgaaatgttatctaaattttttaatagagtaatgttgacagataattatcttaaaacattacatgaaaggaaaggtgtaaaattatattctttttctggactgtatccagcagccacaaatcaaatttataaaagaaatgccctatataaaattagaattagaagttttgatccagaatttatttgtgctatgcaattctcattaagccaaatacaagacaatgatataaatataatatctattaaatttataaaaaaccagcaacaatttattactgagttagtatcaataaatcctgttattttttcaatttgggaaaagcagaactactggcaaataggtgacaatattgacttgttaggaaaacaattgactaacaatttattacataaatataatactatatcttgtaataaacttacaacacaagatacaatatttcactgtttaaacataactaataataagactatttatattccctataaaaaaggattattgttaggtaataaattaaaaatccaagtcaaagaagatgatatatctcaaacacttgctactgtagcactcggagcaggtattggtgaaaaaaatagcattggtatgggattttgttatggacattaaccactaagaagaggggtgaaatttaattgattattgatatgatgcacaattttaaacatttatatgatgaaaatggtgacaatttaatagtagataattatcctttaaaacaaggtgtttacattatcgttaatgatagaggtattagagattttatggttataaaagataaagaagcaataccaaaagataaagaagaattatttaagtatctaagacacagagattatctaagcatattgaaacaatatgatactaacaaagcagtatctggtagagcgaagtctattcatagtaataattttttatcattatttattagagaaaataaatcttcacatatattagaaggttcatcattaaatccttcattagagcaacaagttggatggtattttgatcaatttaaaaagtggcaagaagaagagaggcaggcccataataacaatgatccaagtaatccacaagaatttatattaacaaccttagaagattttgatgaacaattattcaataaaagtaaaaaggctatattaaattctttatcaaatttgccagaacttttaagtgaatatactttggcagataaagattatattagaattttctatgaaatgccaattgaatattataacaaagaatataagaggtacatgataagaaaaatatttaataaaaatgtatatcatatatttaaagataataatgtgtatggtatttctgatatagatcttaccactaataacaacaaaccatccttattattatacagtatgaagactagggtacctctgcgtttagactttgataccttgctaatagctcaaaaactatttgactttctttatttttataaggttcctaaatataataaagaatctaaagcattggaatatgttaatagtatttataagactttatatattccaatggatttcaatatagataatctagatctaaacaaatatactaatacaggccaacctgtttattacattactactggtaatggacaaagttttaatgtaataaactatgatattatttacccatttgattcaaatattgattttagctttaatgattatttatctttagatgaagatgtctatgagaatgatgaagataatataagcgatacatcaaacatcagcaatataaagactcttttagatttagaaagaattgttgataaatatttttttaactttaacttagtaagtaactaccatagtgataaatttattaataataaaaaatataccttacccaataacataagctgcatgctgttttcttcgaaacatttatttcatgattggtttaggaagggtatagatctagatataattgatcctataactaatgtaatggataatttaatatcattatgggcaaatgatcctgatattagtcttattaaaataaaaaatatgctgaatttaagatggtccatacttgattatttatatgaaagagaggggtatgctccaatggaggtaaaagagcactttgaagctatacattataatttaaaagaaaaaatacatgataagtctcttgaagaaaaatatatcaataatactgaagaattttattatgcttgtggtcaattaatctattatttattaactcaaaataagaaaacattaaaaaaacaacaatctacaagtaaatttctacaatgcagaaatagctcaacattaaagatagagatattaaaactttatgaagaagtagcaaataatatatctgcttataattacagatttaataatttatattctatggtatctacttataacgatagcaatgatacaaaggactatatagattatttactaggtgggctttatcaaaaaagcattatttatgaaaaaaagaaacagtaaaatataacgattgcacaactattatctaagttgaaaggggatattaactatgaataaaaaagtatatggcttattaggtgtaacagcagtaaggagtaattataatgcggatttttctagtcacccaagaacaagtgctacaggtgaatttatagccactgataaaactttcaaatatgcatgcagaaaatattggacattagataaagaaaaagtattggctttctcaaatttgaatgataatttaaatccaatgacattacaagaaaaatatgagtatttattcaatactacaatagacaaaaaaacaacaaaacctatagatgttttatctaatttattttcttgtttagatgtcttaaattttggtgctacatttgctatatctaaattaaactttagtattaatggagctgttcaaatacaacaaggcaaaaatgtatatgagtatactaaggcagaaaaattatctcttctaacaccttatagaaaccctaaagataaggatgatggctcagaaaagggaagaactactactgccgaacaacatattttagatagagcagaattcatctatccgttttctatcaatccagaaaattatgatgaatatgtaggattagtgcctaactttaatggatatacagaagaggcatacattaaatttaaagaagcagctagggtaggggtaacatctttaaatacttgctcaaaagctggctgtgaaaacaactttgcattatttatagaattaaaggattcatcaaaagcatacttacctaatttatcttcttacttaaaatatgattttgattcaattaacatatttgatcttactaatatttttactgaattattagaagaaattaaagaagaagtagaaaaagtagaagtatattacaataaatacttatcagatatagttatcccaaatactgatataaaagtagaaagaagaaatattctaactggtaaagaaatgatatagtttttaataatttaaatcagagaggagagaaggcaatttcagcctactttaattggattataagagtaggcgtatacttgccgattttaaatggaagcaattaaattcaatttatcaggtcctacaactttttttaagaaacctgatgttaatagttatgcctactttacttataataatattcataagattgccttattaggtatattaggttcaatcataggactcaaaggctataatcagcaaaaatctattgatacatatcctgaattttatgataagttaaaaactttaaaaattagcatagtgccaaagagtaaaacaggatatttcactaaaaaatttcaaacttttactaacaatacaggattttataatatagatattaataaaagaccatgtacattagtttatagagaacaatggttagaaaacgtaagctgggatatatatatattattagatgaaaatagtgttgataaaaaaattctaaataaattaaaagattatttgttaaataaaaaatgtcactttattccttaccttggcaaaaatgatcatactgctgatatcacaaatgttgaacttattaacttaaaagcaatacaagcacatgaaaaattaataagaatacaaagtttatttttaacagataattttaatattacaggagaaaaacatagtcctaatgagagattaataatattaaaagaaatgttgccaactgaattagatgaattcgataactcttacagatttagcaatttatcttttactaatctcattgttcaaccaaatactagtaaaacattaatttatcaggattcactaagtaatttatatttcttttaggaatttaaaagtcatataatgaaagcatgttataataattatataaacattttattatttacaaacagcttattttcattggtttaacttctacattatatgtatttaaatgtaaagaacagaaaaaggtaattaaaaaattaaatgtttaacttctacattagatgtatttaaacataataatctttataaaaagaaataaaaaggaatagtttaacttatatattatatgtatttaaacaattaatttgttctctcatttgtaaatatacatatatttaacttctacattagatgtatttaaacaaaatcggaggctttttaataatatttttaataagtttaattgctacattagatgtatttaaagttttaaaattataagttaaggatatggttttaatgtttaacttctgcattggatgtatttaaacattatatatatatctttaaaaatatttttctcattatttaacttctacattatatgtatttaaactaccgaaaaacacaaaaaagatataagaatttttcctatatgtttaacttgtacattagatgtatttaaacaacaggaaatggaggttttgcaaatgcatagatataagtttaacttttacattagatgtatttaaaccaaacattaaatttataatctgaaaaggggaagtttaacttttacattacatgtatttaaaaaacctccaatttttagttttgctaaattaatttaacttttacattagatgtatttaaagtacaactatgtactattatttgtttaacttctacattagatgtatttaaacaaaggggcacacaggaggttttacaaatgcataaatataagtttaacttttatattagatgtatttaaactataattttacctctgactttggtattttataaatgtttaacttctacattagatgtatttaaacctgtatgtt

SEQ ID NO: 5 - DNA, 53 bp, Artificial Sequence
  Synthetic primer
aaaaaagcttataattatccttacagatcttacatgtgcgcccagatagggtg

SEQ ID NO: 6 - DNA, 60 bp, Artificial Sequence
  Synthetic primer
cagattgtacaaatgtggtgataacagataagtcttacattttaacttacctttctttgt

SEQ ID NO: 7 - DNA, 49 bp, Artificial Sequence
  Synthetic primer
tgaacgcaagtttctaatttcggttatctgtcgatagaggaaagtgtct

SEQ ID NO: 8 - DNA, 53 bp, Artificial Sequence
  Synthetic primer
aaaaaagcttataattatccttagttcccctcgaagtgcgcccagatagggtg

SEQ ID NO: 9 - DNA, 60 bp, Artificial Sequence
  Synthetic primer
cagattgtacaaatgtggtgataacagataagtcctcgaagataacttacctttctttgt

SEQ ID NO: 10 - DNA, 49 bp, Artificial Sequence
  Synthetic primer
tgaacgcaagtttctaatttcgattggaactcgatagaggaaagtgtct

SEQ ID NO: 11 - DNA, 53 bp, Artificial Sequence
  Synthetic primer
aaaaaagcttataattatccttaactgtcaataaagtgcgcccagatagggtg

SEQ ID NO: 12 - DNA, 60 bp, Artificial Sequence
  Synthetic primer
cagattgtacaaatgtggtgataacagataagtcaataaatttaacttacctttctttgt

SEQ ID NO: 13 - DNA, 49 bp, Artificial Sequence
  Synthetic primer
tgaacgcaagtttctaatttcgattacagttcgatagaggaaagtgtct

SEQ ID NO: 14 - DNA, 28 bp, Artificial Sequence
  Synthetic primer
cgaaattagaaacttgcgttcagtaaac

SEQ ID NO: 15 - DNA, 28 bp, Artificial Sequence
  Synthetic primer
gagatcctgtaaatggtgttgatattgc

SEQ ID NO: 16 - DNA, 27 bp, Artificial Sequence
  Synthetic primer
ggtattatccctcttacacatagcagc

SEQ ID NO: 17 - DNA, 26 bp, Artificial Sequence
  Synthetic primer
caaacaatgatcaagttatttaatag

SEQ ID NO: 18 - DNA, 20 bp, Artificial Sequence
  Synthetic primer
tcatttaaaactggcccagg

SEQ ID NO: 19 - DNA, 25 bp, Artificial Sequence
  Synthetic primer
caaatcaaaaccattgggtgaaaag

SEQ ID NO: 20 - DNA, 30 bp, Artificial Sequence
  Synthetic primer
ctggacaaaatttcatttgcattatacccc

SEQ ID NO: 21 - DNA, 24 bp, Artificial Sequence
  Synthetic primer
caggagaagtggagcgaaaaaaag

SEQ ID NO: 22 - DNA, 27 bp, Artificial Sequence
  Synthetic primer
tggtaaggaatcactaaaataagaagc

SEQ ID NO: 23 - DNA, 28 bp, Artificial Sequence
  Synthetic primer
ccgataccgtttacgaaattggaacagg

SEQ ID NO: 24 - DNA, 30 bp, Artificial Sequence
  Synthetic primer
ttatttcctcccgttaaataatagataact

SEQ ID NO: 25 - DNA, 30 bp, Artificial Sequence
  Synthetic primer
agggtatccccagttagtgttaagtcttgg

SEQ ID NO: 26 - DNA, 54310 bp, Clostridium perfringens
taattttacactaggaaaagagtttaatcctgcaccagcgaatgaagacatatatgcataaatagctttagcttctattgtaagacgagtatctctcattacggctttgggactgaatccatatccttgagacatgattccatttatttgaataaaattattagcattattatttgttgacataaaaaaatacctcctaatggaaattaaagaacaccttagagtaaaatccatatgaaagtactatcttaatctatctttaatattgacttttcaatattaattttatatactatagataaattaagccgattcatataggcaatataagtaaattcatttatataaattaagtctaattatatagataaattttcggcttattactttcaggtgtcccattgatttctttaacggtttggcgattgtctaagaaattaatgggtttttgcttttattccgttctttttaaatttgttattattataccaatttttcatataactttcaatattatttatattttatggaaaaacgagtgtttttgataaaaatttatctaaaaatttaaattaatgacagaagagctaatgctcttcttttttattttatttgtttttttgaaactccagcctatcatatctacgctaaaattgtaaagccattccacaattttttatcggccattcattatattcatagcagctaaaaaatttgctccattttcctttacaattcacttcgatatgaagtcttaggctcaacaaaaaaacaacaacatgagagtgttaaacgaaagttgttggtggaagggggagagcttattcaatgaaaatttgacatgtataaattgaagtttagttattgacatgtataattatacatgttactataagagtatagttaagagaataaaaaatatgaaatgaggttgtaattatgaagaaaatatcagtttttaatattaaaggtggagttgctaaaacaacgtctactgctaactttggagcttgtttagaagaaaaaggagacagagtattattagtagacctagatcctcaatcaaatcttactaagttatttaaagcatatagtatggaagatgtttcaattgcagatgtacttttagataaaaatttagatattgaaaaggtaataaagaaaacagatttcgagaatatcgatattttaccatctaatgttactttagcatttgctgaaagaaagatacttttagatgttaatcgtagtcaacaaaatagattagctaaagctcttgaagagatagaagataaatatgattattgtttaatagattgtccaccagcacttaatatgataacagtaaatgctctttgtgcttcagatgaagtattagtacctattaagatagacaagtttgctttagatggcttggaatatcttttagatagtatagaagaaataaaagatgagtttaatccaaaccttaattttaaagggtgttttataacaatggattcttctactacagttaataaggttataaaacaagaacttaaatcagttttaggagaaaaaatgttcaatacatcaatacatcaaaatataaaggtagtagaaagtacatttgaagaatgtccagttgtattttcttctaagaaagcaagagcaagtttaaactataaggatttaagtaaagaaatattttaatttaaaaggtgtccccgggggacacctaatataaattagttaaggtggttagaataaaatggctaaaaagttttcaataagtgaaggaatgttaaatggaatttcaaaaaatactagaaaagttgaggagtttcaagctaaagaaaattttaaaattgagtatataaatatagatagaataaaaagaaatgagaaaaatttctatgaaatagtggatattgaatctcttgcagaagatataaaattaaatgggttaaatcataatttagtagttagaaaattggataatgatatgtatgagttaataagtggtgaaagaagatatactgctttaagtaagcttgttaatgaaggaaataaagagtttaatttagttccatgtaaagttatagaaagtaatgatatagattcagaaataatacttattcaagctaatgcacaatcaagagagcttacagaagttgaaaaattaacccaagttgaaagattgcaagagttttataagataaaaaaggaaaatggagaaaaagttccaggtaaaataagagatattattgcaaatgatttaaatttatcagctacacaggttggtagatatgagagaataaataataagcttattccagagttaaaagcagttatagaacaaggtaatttaacaatagcaaatgcttcagaattttctagtttaagtgaagaaaatcaaagagtgatattaagcataatagatgataaaactaatatgtctaaacaagaagcagtagatttaaagaataagcttaaaaagattgaggaagaaaaagaattagaattgaaaaaagcttatgaagaaaaagaattagaacttaaaaggttagaagaagaaaagaaaaatcaagtttcaaaattaaaaagtgaaaatgaaaatttgaaaaaaaagcttgatagtaataatattgaggaagaaagaaaagagatagaaggtcaaattaaaattgaatttgaagaaaaacttaaaaatgaaaaagttatattagaagaagagttaaagagtaaatatgataaaaagatagaagatataactaaggaagctaaagaaaataacttagaaaaacaaagattaaaggatgaactttcaaaattaaaagaaaaatctaataatgaagttgatattaaaaatacaaaagaaaactttgtgttagttcaaaatctaaaattaattgacaactcatttaagaatttaaaaagtcaaattaataagatgaaaaaagaaaatgttaaagttgcagaagaaaccaaagctaaagagtttttagaaaaatatcaaaaagaaatttctgacttattaaaaaagttataatatgaaatatagatgatagggagaaaaatttctccctatatagttttatataaatttaatgatctgtaccttaatgattcttacaaaatataatttgtattttatggaggcataaatggaaaaaatattagctgaaaagagaataaatatatctttttataaaagaaaaaatggagcattggtaacaactctatatttaccaccaaaatggttagaagttattggtattacagagaatgaaagagaatgttttttctacatagaagataaagcaataaaaatatctaaagaaaaacagtcagaagaagctaaagagaagactatatcttttagtaaaacttcaactaaaacatatttaaataataaatggctagaatatttaggtgtatctgaagatgagagaagctgtataatagaattaagaaagaaagacataacattagtaaaagataatggaagagatatattagatatttaataaaaggtgtccccgggggacacctttttattatcgataatagaattaaaaaaattaaaagcaatgatattatcattgcttttaataaattattagatatactaaaaagattaattatacagtttgattttagcataaaaaaataaaaaatcatattcttgaatcctttaaataattttgtgtaaattgaataaacaacttcttcttggaaataatttgatataccaataaattataagaagaagttgtttttttagagtaatatgtcgaaagattttttaagaaattatataaaggaacaaaattttaatgatagcaataatgttttaaattcattgaaagatttatttaatgatgttcttcaagaagtggtttcagcggagcttgacgatatgcttggttatgaaaagaatttaactaatcaattttataatagtagaaatggttattctaaaaagactatcaaatcagaattaggtacaataactttgaatattctaagatatagaaattaggagtttgagcctaaaataatttcaaaacatcaaaggaatattaatagaattgaggataaaaatttaaacctatatgcatcaggtataactactagagacgtagcagggcaaataaaagctctatacgatattgaaataagtgctgaaacagtatctaatataacaaacagaataatgccacttgtaagtgaatggtaaaatagacaattggaaaaaacttacttatttgtatttatggatgctattaattataaagttagaaaagataagcatattgttgttaaggatgcctatgtagttattagtgtaaatatggatggaatgaagtcctgggtatttgtataggtgttaatgaaagcagtaagttgtggttatcagttcttaataatcttaaataggggctacttgtgttttgtgttgacggacttaagggttttaaagaagccataggagccgtatatccattttcaaaaattcaaaggtgtataattcatcataaaagttaggaggataattgggataatcttagaactttatttgagttttcccctagcataagaaaaatgttatatacaaccaatgttatagaaagcttaaatagtcaattcagaaaatttactaaaactaaattaatatttccgaatgatgttagtttaataaaaatgttgtatttagctacagagaaggttaataaaaaatggactcgtaattacccgaactaggatttggtaatcaatgaattaacaattttattcaatgaatatttaagtaaagaatgttaaaaaaagagccttgagaaagcgttctaaaagctctaaaatccaaatcaaatgtatattattgcctattattgggtaaaatatacataacaaatattttagtagatcaacttaatttgtcgaaagactttatttattttattatacctaccaattaagttctaaatatatgtactaatggttatacatactttattcatatttagttgatttttattattattaatagttatatattaataataaaaatgcttagtttataataatcgttactttaaataattaaatcgataaagctcaagagcagcattactatgaaatcttctgattcattagcaatactgctctattattttatctttttattataaaaagattatcctatctgcttgttttgcaacataattatcatgagtcacgataattattgtttttccactttcattaagttcttttaataaagatattataatatctctattttcttcatctaatgagcctgttggttcatctgctaaaataatttcacttggttttaacattaatctagcgatagctactctctgttgctcaccaccacttaactcatatatatagtttttttgacatccctctaatccaacaaattttaaacatcttattatttcttcttcaatctttttcgtatttttaattgtgtgcttaatcgcaagtcttaaattctcctctacagtttcttcatctaccaaggcaaaattttgaaataagtaacttatcttttcccttaaaaacttatttgctaatttgctatttatttttatattttttacaccgtcaataattatttctcctgaatcaaatttttctatcaagcctatcatatttaaaagggtactctttccacaaccacttcttccactaatagcaatcatctcacctttttttatactcaaagaaaaatccttaaatattaccttatcaaaatactttttatttaaatttgaaatttctataatattcattaatattctccctttatcactttaataagattctttttctctaatgaattaatattaaatataataaaaactaactctattactactaatattagagtgaagtatattatattaatatccttagtaattaaacttgctatagcgagtggacatgtccaagttattaaaaccattataaagtaattcatgtatctataaatcaatctatatccatgaagttttttcacaattattttattcttattttgattaaaatataaagatgtattctgtaaaataatgatgctaattacagcgagtaatattactatagcaaatataataactttcacttttgcttttatattaattattgtacttgctacattatcatatagattataaggatctattaaataaacactcatatcataatatttttcaagtccattaataacttcctcttctgaattagctcgaatcttaaagggactattattgtacccaattatcttatagtaacttaccaatttatcattactttctgttaaaacactgacaattggatcagttacataatttccctcttcaggattcacatctaatagatatgaaaaatatttttgatttgatttcatccaaataattttttgtttttgttctaccaaattaagctttccatctgctgttttatgtgaacaagtggtacttgaacaaggttcttgcgaattgtaaccataatactccaaaatttctttttcaaaattcctatatttttcaggaactaacaaaattctatctttttcatcttcacttatattaattatattaccatctacatcgtatactttatgttttaataaataattaggatttacaattatagtctctctcatatattcttctggcaacatctgctttgcttcttccattgatgttggctcatacctattaaaatctgctaatatagctccttgtttattaaagtataaatatactgctctttctttttccatctcctcaattgaaaatgattgtatactctcatcgttaaatcctagttctggtagaatataatattgttttgtttcttcccatactttataatttttttcatatccctttcctatgctcgataaatcatctaatgcattactaaaaaaaatcaaaattatactagctaatataactttcacaatgctatttaatataattatactttttacaggtcttttattttttataatgttagatagagttattttacttacatagatatatggaattatcacacttacaatagtaaaaattatcattatactatatatacatataagttctagcataaatttccaaaataaactattaaatgtcttgaaattaaaaaaaactagcaatactgttactactaacatcacaattacttctatccgtagtacctctaataatctttcttttaacattacaaatgtactatgtcctaataacttttgtatacctattttcttatatgatccaagtacttgataaaagatcataaaaattaacccaataaaacaaactactaaaataatttttaaagtttcagtgttatattgacttgaatctcccattacccttttttgtacaataattgattcactttttaaatcttctattagcttatctaaaatttgctcattctctatctgtactataaataaattttcaaatgtatttatatctaacttactttttattgtgcgaatttcatggatattcttgccattaaaatcattaataactcctatttgttgtgtatcttctgaatcaattgttgataaatatgaatctatattatctttttcatggaaaaatcttcctgatactattggaatatggttctcagtttctttatttgaaaaataaccataatttatatactttctcacatcttcatttatatcaacttctgaaaagaaaatattcccattatattcatccaaactttttattatactttcataggcggtattatagttttctctatctggtatagaaattgtcacttcaaaattttccaaatttccttgtaaattttttagcttcataaattcagtatgatttcttactgaatatactccttcaaaagataaaatagtaataataataaataaaataattaaagctactttttttttcaaaatactctccttttcatattaatataaaagatatctttaaattattatttaaagataccttttaaacattaaattactataaatgtgcgtaatatgaattccactctgttacccctttataatacttagtttgtgcatgtgcagttaatttagcatctttgatatctttagcttcataaagagtagtacctaccttaacacgtgctgtagccctatgcttttgctctccacaataaaactttgaactttgtgcctgtgaaaataaacctggtaatgaagctgcctcaaatttgtctgaactatgagtataagctaaggcggttgtacctaaactaccaactagcaaaagacttgcgataaaagtttttattaatttatttcttttcatattctcaccccctacattacatattataacaaaataaccattttatgtaaacgagaaattgcatttttcttttaaatttgcatggaaatttttttagctagtaaacttaaatactctcctctttcaataatttattaagagttttttctactcttcacttaataactttttgtctaggctcttcactctggtatctcaaactccgataacacttttaaaaaaaatctagttaatatttttaaagtgctggaacaatatctaatataacaaacagaacatgccacttgtaagttaatggcaaaatagaccattagaaaaaacttacttatttgtatttatgaatgctattcattataaagttagagaagataatcatattgttgttaagggtggctatgtatttattggtgtaaatatggatggaatgaaggaagtcctgagtatttgtatgagtactaatgaaggcagtaagttctggttatctccacataaagataaaaaggaatttgcaaaagacttgaaaactatttacggttcagtaaacgaaacagaaggtatgaaaaacttaattgaattacgtgaaaaatggggttctaagtatccaaatgtcgttaaaagttggaaagataattgggataatcttagcactttcttttagttttcccctagcataagaaaaatagtatatacaaccaatgttatagaaagcttagatagtcaattcagaaaatttactaaaactaaattaatatttcctaatgatgatagtttaatgaaaatgttgtatttatctagagagaaagttaataaaaaatggactcgtaattacccgaattgggatttagtaatcaatgaattaaaaattttattgaatgaatatttaagtaaagaatgtaaaaaaaaaagagccttgagaaagtgttctaaaagctctaaaatccaaactaaatgtatattattgcctattgttgggcaaaatatacataacaaatattttagtcgatcaacttaatttgtcgaaagactttaaaaaatattaacttaaaaattaaaaaatcttatattatttctaagaagaaataataatttacacaaagtactttacaggctctattattgagttttgatatagattaaaatatagaaaatctttttttattttttcttttagttaaatctaataatgtattttttaaaagttctatttcttcatgtaaatttttataggaagattgcttttcttctaattgttttattattttcaagttattttcgataatagtatttaaaatacttatttgcttatctttaaattcaatttgtttatctctattttcaatttgtgattgtaatatgtttatagtattttgatataagaaatcttcatcaacagtaactgaaacctcatgttgtatttcagtagtttctttttttatttctttaggagttaattgttttttcttttctaattcttcttttagtaattctgaaagttcattatctataataatttgagaaccattttttttaacaagtggagcaaatctttttcttctaagtatattataaatttcacttcttgtaacatttaattcttcagctaaatcttgtactaacattttaaaagctcctaattcattcttgataataaattctatattactcatattctttaaaattatgtaaaatccttttatctaattaaagaaaaaatatcttcatattttatatgaagatatttttttctttaatttttatcgtcgatggctattttataaaataagtaaagagatatgattaaaaataaacaagggaaaatataaagtactgagttataagcggaagaacttgtagcacttaatccataaagataaataaacatccatgaagagcaacatagagaaataatacaacatagtaaagtcatataagacctccttttttcattttaaaatattatataaacattatataagaattatacattaaaatttaagacaacaaatggaaaaaatgtgtgaattaatatgctaggtattctaatttaattgaatgaataataaattttatagtgtataaatttaatgaaagaaggtatatatataaaaaataaaaaaatactaagaaaattttcaattttagctttacttacagtttttacttcagtaggaatacaatcaattgatgtcagtgcaaaaactataaataataatgaattatatgaaaatttaaatatggagaaagctataccaacatcagatttagaaaattatttgccaaatttagattcaaattttagtgttactgaaggggaaaatgttatttactttgcaaatcaaaatgatcttgacctatataatagtatgaaagctggaaataatgctcgttatggagaaggcatgaaagtagaagttttagatagtacttataaaagtcatctttggattggatatcatagtggaacatcttcatgggctaaggcatcttcttacacattaacaaagggaaaaacatattctacttcaggaagttattcttacaagggttatactgtaaatacaggattttcttatactaatagtgtagcaacaacaattccagcagatagttcaaggtatagtagattaggaacttggggtgattttacatttaaatattgtaaatatatagaaacatcttatggtcaaccgacaggaagagtaacatatggagtacaaaaatcaatgtctaatcattatgtacaaccaacttatcagtagaaatcaataaagtggcgattaaaaatcgtcactttattttatatcaaaaacggttgtttttgatacgtttttttgaattatgaaaacaagccattttttttgtataaaaatgtatcaaaaaaggtaccataatctattgagattatgatacctttttgatacaatattgttaagaaatttagaaagtggagatagaaataattatgttagttggatatgcaagagttagtaccgaaggtcaaagcttaaatagacaaatagatatgttagttgattatggtttagataagagaaatatatatcaagaaaaaataagtggtactaagctgagaagggatcagctagataagatgattgaagagcttcaggaaggagatacagttataattactgatttgaccagaatatcaagaagtacaaaggatttgttaaatattatagatagaataaaggaaaaaggagctagtattaaaagtctgaaagatacatggttagacacatcaggcgataatccatataatagctttttattaactgttatgagtggattaagtcaattagaaagggacttaataagccaaaggactaaagaagggttgagaagtgctaaagctagggggagaaatggaggaagaccttctaagagaaatgataaagctgatacggtagggttattatatagggaaggttataaaatagttgatatagtaaaacaaacagagttaagtagagcaactgtatatagaattttaaaagacttaaacttaaaataataatataaatatgatttagaatttggagaatggattataaaaaggtatattaattatatatctgaaaatttattattatattataaggataattaataaatttaaggtgtcctcaggggacatctattagtatagaatagtagatgaattaaagatttaggattaaaataatagtattgtaaaatattaattataataaaaaagaggggattttatgagagttttttcaaataaattacttagcacaaatcaactacctttgcttactttagctaataacgaaggatggttagacggtttttcagatgataatttccttattaaatgtttaaacaataaattagattattttgatgaacattcaaatttaataggaaatagtccatatttcaatagtaatattcaaagttgtaatacatttttatttaacttttctagaatgttaggtattctaatctctaaatttggaaaagatgatgttaagaagttttttaaacattctctaattgctggtggaaaaaactatagtgatgaacagttttttagagcttattctgaaattgttgtaattgaatttttattaaaatataatcaagtagaaaagtgtatttatgagcctaaacttggcgttaatggttcaaatcctgaagcaagattaatatgtgaagatggagttattgtagatattgaggttaaaacaccaggttttaagaaagaagaaagtacaaatacaattattccagcttttattttagatgatgatattgaacatgaatttaaagaaatagctgaaaagcataatttgaattatgttagacctagagttttgaaattaaaagattttataaatagtgctgggaaaaagtttgaaaaacctaaaagttcaaaacatataaatttattatatataaattggacatattctgatattaaattttcaggatttaaagaaccttatggattattatacaataatttaaatggaattttaaaaaataaagattttgcattacgtttaggaatagaagaagaagcattagaaaaaataactgcaataattatatatcaagattcatttgattctttaatatttggtgattttagagatgtttggaatggatataaatttagattattaccaaatcagttaatagattcaactttgatagataaagaacttttgtttaaaataacaggaatgaatccacctgttaagggagatcatttagcaccatatttattaagttattctggtagtaaagaaaattgtttcttaattgcagatatgataaatagtaaaattcaagaaaaaatttcaaagttaaatatagatggatttgaagataatttcatttattttaataaggatttttgggaaaaaacttataatgaacaaatgctttattttaatcagtttaaagattgttttattccacaagataaaaatttaaataatgttactgcatttataagtatataaatatttattattgatttaattttccattatagtgctagttatttttactattataaagtttaataatttacattgtttaaactaattgctaaatagaattttaactcatgttttaaaagttaaatatatattttaaatttaaggtgtcccacggggacatctttttgtttttaaaaggtaaatatgaataaaatttagataaaagtgtaaaagaattatttttattttaaatttgttaaaattttgatataattgaattgtaaaaaaaatttcaggggggaatataaatgaaaaaaattatttcaaagtttactgtaatttttatgttttcatattttcttattgttggagcaataagtccaatgaaagcaagtgcaaaggaaatcgacgcttatagaaaggtaatggagaattatcttaatgcttttaaaaactacgatattaatacgattgtaaacgtatcagaagatgaaagagtgaatagtgatgaaaagtataaagagatgttagaagagtttaaatatgatcctaaccaacaactaaaatcttttgaaatacttaattcacaaaagattgataataaagaaatatttaatgtaaaaactgaatttatgaatggtgcaatttatgatatgaaatttactgtatcatctaaagatggggaattaatagtatctgacatggaaagaacaaaaattgagaatgagggaaaatatattttaacaccatcatttagaactcaagtttgtacatgggatgatgaattatcacaatcaattgggggagttgatccaaaaacatattctactagatttacatattatgcagacaatatattattaaactttagacaatatgcaacttcaggttcaagagatttaaaagtagaatatagtgttgtagatcattggttatggggagatgatgttaaagcttctcaaatggtgtatggtcaaaaccctgattctgctagacaaataagattatatatagaaaaaggacaatctttctataaatatagaataagaatacaaaactttacacctgcatcaattagagtatttggtgaaggatattgtgcatagaaaaaaatatgaagtgactaagtcacttcatattttttttactattaattttattatataaaaacctaacatacatgaaagtattcttaatacagttatatcaaaattaaagtatgggaaataaaataaaaggctaaaaactatattaaaaactataaaaattattaaattaggttttaagttgttatatttatttatgattataggaataaatattccaaagggaataaataaaagtaatattagtaattggtctaaaaaatatacatcatcgataaaagaaaaattaccagtaaaaattgaacttaaaaaattaaatgtaaatttaaaggggataaagctcccatgtaaaagtggactagatattacggaaatatttttcacacattttattacgaacaatgtatataagattattaatactgaagatattatcctattaggtaaaagagatttctttatagaaccttctttaatagatttaacaagctcatctaattccattgaatcaatagctttcttttctgcttcttcttctgaaaaaccctcgtttaaaaagtcattttttatttcttcagcattatcaagtaattgtaattttagttcatttaattctttttgtgatatatctaagttttttagtctacgatctaaagttttaattaaactcataatatcctcctttagcaattcttaattaaattagtgattaatgaaaaatccattagctttaggttaagttcagttaatcctttttcagtaattttataatactttcttttcttttttgatgtttcaagttcaacaaaataattttcaattagctgtcgttcttctaatctttttaaggctgggtataaagttccttcacctattgttaattcattttctgtcagattttttatggtttttgaaatttcatatccatacataggcttattttttaataaagatagcaaaattatttctaatgaaccttttaatatctctctatccaataaatcaactcccttcaagttaatttaatattttatagtttaattttacacaaatatacatcgctttacaaggtataattatataaaaaaactaaaatttcaaaatattacatggaaaaatttatatgactttactattagaaagtttagtgacttacattggttcaactaattgctaaatagaacaaaaaataataagcctaagagcatttaatactaactgctcttaggcttttattttaaaattctatttaacaatggattttcactcaatgttttaaaagattatgcttattacttgaaatgaataaggagagaagagctaaggctcttctttttattttatttgtttttttgaagcttcagcctatcatatctacgctaaaattgtaaagccatttcacaagtttttttatcggccattcattatattcatagcagctaaaaaaaattgctccattttcctttacaattcgctccgatatgaagtcttaggctcaacaaaaaaacaacacgagagtaattaacgaaagtgttgaactaaaggaggattttgagatgaaagattatattatctataaacaatttggtaaagaagatataaaggagggagatttattaagagttgatttaatagatggatttaaaattaaagatatcaaagaattaaaagattttaacttagtttatgaaactaaaggacatgaagacttttgtacaaagaaaggaaaaaaggtaaaacgaagcgttagatatattagagtttttaagaaaaaaaattaaaataaaaggcattacccaaaaaggcaacacctaacacacaattagattatagcctttttgggaatgaatttcaagaaggagttaataaagatgaaaaaaattgatgttgtgaaagtttatgttaagaaagaacaaagcttacaaatagagaaggatattataaaaaaaccagagcaagtttttgaagtagttaagaactttttaggtgaagttgatagagagtatttaatagttatagtgcttgatgtaaaaaataaaataaactcaatttcagttgcttcagttggtacacttaattcttcaatagtacatccaagagaagtgtttaaaactgcaatattagcaaatggagcaagtattattttggctcataatcatccttcaggtgatacatcaccaagcaaagatgatataaacataactacaagaataaaagaatgtggagtgttaatgggaattgaacttttagatcatgtcattttaggtgatgaaaaatttattagtttaaaaaatgaaggaataatttaattttaataatagtgcattgcttgtaagcaatgtgctatttaaaaaggagtgaaaaataaatgaatatgatagatatatttgaatcaggacaaaaattcaagaaaatattagaagaaaaaaatatagatagagctattattataactaagttagaaggagaaaaaaatctattagatacatatatagaaatatgtatagagaataatattaatcttaacagagaaataatagaagttcttatttatgcaaaagagtataaaacgattgtaaatattaaaaaaatttttgtcctaggattaaaaggtaatgaaatgattataaataaaaatgatgatttatataggtgtattgaagaaaaagtttatttaggaaattaatatagttaagggtggtttttatagtgaataatataaaatataatatagagtttgaagatactattgataatttgattttattcaaaaaaataaaattagaagatataaataaagctttaaagcaatttggtagtaatgattggggagttttagataaagaagaaaaagaagaccaaaatttattgattatagaaggaaaatataaaggtgaaaatccaaaattaaaatattgttttaatggtatatatgaaatgaataaatacttaataaacattcgtagtaaatatgaaactttaacgaaaactttattaataaaggttaatttaattgttaggttaagtaattaaatgaaaaaggagagaagagctaaggctcttctttttaaatttacttgtttttttgaagctccagcctatcatatctacgctaaaattgtaaagccattccacaaattttttatcggctattcattatattcatagcagctaaaaaatttgctccattttcctttacaattcgctccgatatgaagtcttaggctcaacaaaaaaacaacacgagagtgattaacgaaagtgttgagttaaaggaggaatttaaagtggaaataaagtacattgaaaagattaatttaactatatacaaagttaaggatagtatatatggtatgagtagttatttagatgtagattttgatgaaaatttagtagcgattaaaggaacaacatgtaaatatggttatttcagaaaattagataaaaatgaattaaaaaatataactgaacttgttaatgagaataattaaaaaaggcattacctaagaaggcaacctaacacacatttgccttcttagaattaaatattaaggaggaatacatatgatattattaagagattatttaagtaaaaaaattagtgagcttgatgaaatgaaaagtggagaaaaattttctttaaactcaattttatatgctatcagtattatagaaagtgatgataatttaatattaattgatgaaagtttaaaagggactttggagatttttaagtattcagatgatgaaatttcaagtatatctttaaatgatttaatagttgaatgtaaagatttattagaaaattggttgagagaaaataagagtatcaatgaaaattttaatataataccatatgagatattaaattcttctatggataagttgttagaattagttgaagatagtattttttttgatgaagctttcaaaaatatgattgaaaaagaatagatttattaaaaaaacaaatatagttatgattattcataactatatttgttatgtaagagaatagaatttttaaataaatttcaaaggtgtccccgggggacacttttagttaatattaatcaagtgatataatatagttaagattattcataactatatgaggtgtaagatgaaaataacatttgaagatgtattaagtgaggtaaatatatcaaagcaagatatattagatttaaaaattgaattacgtaatgctaaaaagggagaagagcttccaattattcttaaattaatagggttagcagatgaagttggtcaatattattataaaaaaatattttatgaggatttttttataagtattgaagatattgctaaacatttagatgtatctattagatttgtaatgagtgatattattgataaattagatagaatagaatttccatcagaagaatttattgatataaaaagttcaatgaaaaatgtcatatttttaaatataggagatagtagtaagaagggaaaaaacatatatacatcaactaagtattcaaatgaaatattaaaagaaaaagttaaagtgttgtatagaaaaaaggttttatatagtaaagaaagttatataaaatttttaaaagaacatatgaagcttttagaaaataatattttaattaatttgtcattagaaaaagaatggattgaaaatataaaggtaagacttataaaagataagaaagttactaatagaacatttattaatttgcttttcaataattttatgaaaaaaaataaaagagaaatagagaaatataaggctaatgatattttcgatttcaatgctttaatagagaatagatttggagatagccaagaaaaaagagaacttacagactttaaatcaatgaactctttaaaagtattttttgataaagtttatgaaacagaagtaactagagctattgaaaagtcagattatagttttgaatttaatttagatttgggaagaaaaaagaatataaaaagatatatattaaattcagaatttttacttgaaaaggttaaagaaagttttaattttaatattgaagaaaagtccgagaatgaagatgattatgaaatgaatataccagctagttttttattgaagaaatatgataataatataaagcttttaattggggattttaaaaaatactcagaaagtataaaaagattagcaataaaagatatataatattatgaatattcataacaaaataacttgatacgtataatgatacgtgttataatatatatgtaaggagggtgaggtaatgaaatcttattcttcaagagaaatagtgaaaatcattactaaggatggttggtatgaagttaattgtgttggtgaccatcaccaatataaacatcctactaagaaggggagattaacaattccacatcctaagaaggatttaccaataggtactgtaagaagtatctttaaacaagctggaattaagattttataatcttaattctgcctccttaccaaatttaaaattaaaaggaagtgtttctatgaagaaaaaagatacttatatctttccagctatagttacaacagaaagtgatggtataacaataacttttcccgatttagaagggtgtataacttgtgcttatagtgatgatgaaattatgaaagtatcaaaggaagctttggggctacacttatacggtttagaaacagatgaagaaattgaaggaaaagaattaattccagttccatcaaagttgaatgatctaaaacttgaaaaaaatcaagcaactacattagttgaagtttatatgccagttattagacaggtgttagataataaagctgttaaaaagactgtaactatacctaattggttagatgttcaagctaaaaaatatgaaataaatttttcacagttattgcaagaatcaattagaaatttacttcagttataatatgaaaataaatagtgtactttctttttatatttatagaaagtgtgtaacgaatgggaaatgataaaataatagatattaaggaaatcatataaaattgatacatccttttgtattactagcttaaaacaaacttttgtgcaattttgtagtgaaaatgaatgttggcctatagtaaaaataaaatgaaataattagattaactatatataatttttaagaatttatgattaaaagaataatatttaatttacacaaaattaaaattgaacaaatagtaaaaaaatataaaatatggtaaaataaatcgaatattataaatagaagggggatttttatgaaaaaaaattagtgttagctgctgttgctttaataagtgtattaaatatatcacaagttaatgtaaaagcgaatagtgttatagatacaacggatacaacagagcatgttgttggtgagttatctatagaagatgaattagctaatgaagaaaagtataatttagctaaagaatatgttgaaaataaaaggcagttatacggatataactcatcgaaagttttatattttccatatgaaaggcaaactgctggaaattggtgtggacctgcagctgcttataatgcaattataggggctaatccatcatacaaagggaaaataagccaaaatagtttggcgatgacactaaaaactggagtacctggagataagggtacagattttccaggagagtggaaaagaacaatgaataactatttaggtgctaataattatgaaattagtaaaggaagtagttattcttattcagactggagaaatagagtgaaaaattctgttatatggactgtagataaaggctatgctgtaatagctgatacaaaacaaagcccatatgggacaaaattacatcctaattataattatatagatgatagaggtcctggaggaaagccaacatatcattatatagcaattactggctatgatgatactcctggaaatgatagaatgctatatagtgactcgcatcaagatttcaacggaagatattggacttatacaactaatgttgcaaaagttacacatggacatggaatagtatggtaaattatttaatgtaattttaaggtataaaagaagaaatttttaaatattctttttttataccttaattatataaattttaacagatgatataatttaataccaaggagatttaaattatgaaattaaatctaaaaaaaagtcttttgctagtaattataattttgggtgtgttagtaactcaaataaaatttaaatataaagaatataatttgcctaataatattagagtattacatgcagatgataataatttatatgtacaaaaaaaagaagataataatatatatatatatgatttagataaaggcaatctaaataaatataaaaaacctatttatggtgaaaaaataataaatatggttttttctgatgattggattgtttggattgaagaaagtaatttggaatataaaatattatatgagaatattgatactggaaatattagtgaaataaataatatgactccaagttatattcctacaataagcattgataatgattatttagtatattcaaggttaaatgaaagtaattttgaattagtgttattaaatttgatggataaagatttagttatattagaaactttaaatagtgaaagcaatgaaaaaatttctattccttctattagtgaaaatttaattgtatggtctaaaagcaatggtaattattcaaacttatctagtaatatatatatgtatgatataagcaaagatagtaaaattttattgtcagaaaataattcaataataaagccacaaattaaaaataatattattatagcaactaacataaaagataatagtgattttacagaaagttatttaacaaaatatgatttgaaaaattcaaaatggaatgaattcataagtaataaaagtaaagtttataatgatgtgaagaatttatcagtagatgatccattaataggggaaaattatatttcttggtgggataattattctaataaacttattttatatgatataaaaaaagaaaaaacaataactttaaaaaaagagaagcctaacgaaattaagcaaatatactttttaaaagataatattattgtatataggattgaaaatgataatggtagtgagcataaatgtattaaaattaaataaattttaaaataggagtattgtagtattatggtgaaattttttaaaaataggtttgtttttataatattagtaataattattttattatttagtttttataaaattttttatagaaattatccaatattaaaacctacaattactataaaatataataatgaaaaaattttaagtacacctggagagcattcttggtttaatcttaaagaaggtggaaatagttatttagtaagcaaatcatcgtatgaatcaaaagagcctatatatgtaaaaaaatgtgataaaatatatataaaattttcatctattcctaaagaggtgacagtaaaagagatatcaaattcaccatatataacttatgaacattttgaaagtaactctaaaaaagaatattttttctttagtccagatcaaataggaaaatatatttttgaagtaagaggaagttgggatgatacacatacaatttcagaaatatttagtgtatatgtaaattagatatctctgaaaaaatttaattatcacaataagatggtttaacttattgatcagataggaagatttaggtcaatggttttaatgattttcaacatacaattcttatattatggctattggcttactaatggaaaggttttatatgtgttttgttaaataaatcaaataatattcaaggtcaatcttcatggacaaatagatgcattggtcgattatgatgtaaatgaaagatttattctttctaataaatatagaggtaaaaccttagatagagatggattaaatgagcttttaattataatcagatctgaagccactttagtagtaaaagaaatagatagattaggtgaaaatcgaaaagaaactaaagagcttaaactatttttgtaaaagaggtattgtcatgaaaatgagagatttctagaaataatggctaatgctcctttagatgttattttagaagaagttccaagaatgacatacaaagagagtataaagtattttttgggagttacaaatggagatttttataattcaaaagcagataatatttttgaattaacttatgaagaagtgataaggttatctaaagacaataatttttatgaagataccaaaaacaaacttaaaagattaattaaaggaaatataaagtataatgaaatagtataatttaaatggggagcaatataattatgttgttcctttttattttttataatttacgctcatttacgatatactcgtaaatgagcgtaaattataaaaagaataaacttaatattcatgcaattcttagcctactatcgttggccaagaatcctattttcaaaattaaaaaccaattatttataagctttatataaatttaaaagtccaggataattttattaaacaccaggttaacactcctggactttttctcttttattcaattactattatcttatacatattcatacctgatactctttttactgaagcttttatattaaatttctctttagttattttatttattccattttttatttgactatcacttactatactatcatccatccattcaaatgtagctatctctataccatttaaattttcatcatatattttcccttcatcttttccaaattgaatgtatctgttttttacattttctaatattttatttgaactttcatcttttattttatcttcagcttttttatcttttgttgaatcatttaattcacttcctttgctttctgttgaatttacagatttcaattcactttccaacttagaaacacttgaattaagatagtctattttttgatttttaagagaaatgcttgtttgtaaaaacacaattattaatactaaaataattatcactatacttgtttttttatttcttttaattttttcaattaattcactaaacatattactttcctttcaaaaaagaagaactattaaaaatagttcttctataatatccttatagttccataggtttattttttattctaacttcttttacaggcttttcaatttcaatagttttttctttttttaaaggcacaatttctatatcattgccctcacaaaattctaaaagatctgtatatgtccaacttttaacttccttttccattttagttatttcttcttcagaaacttcaaaaccacttaattcaggtactaatatatcaatagcataatctctaaattcttctatagattttataacttttaattcatcaggattagaattatagtaaacctcaaccccattagatagcgaagctgaaaataaatcatctaaatctttctttaagtttactttttcttcacttaaatcaaatccaatcctttcattgataccagctctatataaaatatctatttgtttatttaatttttcctctaaactctttgtaaaatctttatataataaaacttctaatgaattaaatccatcaataggtgaattatattcctttacatattcatttattctctctatacaactgtaataagtttttgcattgttatatactattggcattgatttaaagttcaatatgtttaaaaatgtacttttatcatcattagcaagttcattcatagtctttgcacatgatttttctaattccattacttctgctaaactttgtctttctaaattaatatcaacatttaacatagctctattaggttctattcctatttctttatagtcagaatttgatatatgaaaactaggcttaaaactattatcaatgttattttcaggttcaattccaaacatatctgctaacctatatatagaatccttagcacttataccttctgctttagatacaaacttaattccatctccaccttcaggttgtcctccaaaatcataaaagtaatttttatctatatttatacaacaagaagctgttttttctcctcttaaattgcaccatagtttattacctcttttaactgtatctattccaagtttatcagcaatatctcctattggaatctcttttaatttatttatatcataaaaaggctctacttcctttttaaacgctttttctttgttatccaatgtattatctatactattacgtaaatcttcatatcgagccgattttagctctttattaatcaattctttcagatcatttacatatccatctcctatatcaaaatgtaaaggtattactttctctggtgcatagtgtagttttaatttagttttagcatatggataatactcatccctttgctctgcttctctttttaattctctaacttttaactctgcttccttaaatctttcatttggcttctttaaggtcaattacttcaccttttttaaaaaaattctcttcgcaaaaatcaactgttatatatggctctttaaatactcctttctcattcaactctctgttttcatcacttataaatttatctgaagataaatttatatctttttcatattccatacttaaaacctcactctcattttttttataaaaaaaagagttattagtcttttcaacttctaactcttttttaagtctatataaatttttattatcatcaacatatattaaattttctaaattataagtttttcctacgtaaatatctctatatgaatcatcttcttttactaccataacatgatttttaccagtaaaatttttagaatctatttctttattttcatcaattttaaaccaagtataagaattgtttttctctattagttcctccaattcttttttacttaattcatttattttcactttatctttacctaaaaactcttttactgcttcatcttcaattaatatttctttctcttttatatttaaaagagaactttcaatagtttctataaactcttttgtagtttcttttacttctttcaaaagtttttctttatctttaaaatctctatccttagtccaagattttaaatatctaagagaatattcttcagtatctatattaaaataactacttactgaaaaagcgaccatttctgcttgaaactctttttcagcctgagtataatttgagaaagtttcacttgtatgcaatttagcatgagctaactcatggattaatgtttttatattttgtagctctgaatttctaggatttaatgctacttcattagtaaatgtataacttattccttttacttgacctaattcacttttaggctcaataatcttaattccaattttatctgctaaattttctaaagaattaaaaaagcctttataattctcaactgttccttctaaccatctattcggaaacaatttaggtatttcttctaaaggtacattagtttgacttacatcaaaaacatatccttgtttaaataaagtttttccgggaataaactctaatttcttttcctttattaagactttctctctttcagttgctttacttacaagtttaattgttccatcttctgcttcaaatctgtcacctaattttgttggtactaaaatttttattcccttttctcctttattaaccacataccctttctctttccaaaatgcaaaactccctactgctctagctcctctaaactgttcttctataagtattgaattcttaaaagaataattgtaaaacttagacataaaagaaagatattcttttatatcttcaggtgaattaaaaaccttatctatttttttatttgcttgttctacgagaaaatctacttcttttttcctttcctcattacttttctttttaaaagccatacttatttcctccttaaacattcatacttttataaaattaaagagtgcagccatgtaaaaaaacatggaagcactctttaatttaaatttaccaagtctaaattatttaacctcaatattagcgttaattatatattctaataatacctttttagctttttcttctgaatcaaccacatctattaaattatcttctaaaccttcttgttctatttctgaaacccctccaaatccatttctatttttataaacataatattttttcatatatattcactcctataataatttttcacctttagttctttttaaaaaaataaaagagtattttaaaaatactcttttaaacttcataattataatcttctataatacttttattatttatatcaactgcaaggatcattgtgttatcttcttctttttgatttaattcatcacttaatagcttaatataatttttatttgctttaacaacaatatctcttttttcttcaagaagataaactgaaacttcattttctcctacaatctcattaaccattgctaaattttcaaacataaaatattcctccttaattacatatcatattcaatagaattttgtaatttttcatattctctttggtttttcatgctattaatatcatcatttaaactttttttcatcatagaaatactttgtttagttattataatatttctatttatttcccatttttcctgtaaattttcaaactttttttgactttttaagtcttcttcttttacatattctttaatttctttaagaatagtgtttcccattcttgtatataggtcttgaattttattgtctttatacgttgtagtttctacttttcttttgccataaacctccttataaaacttgtcttccttttctaatctatcaactaattctttaaattcatcttttttatatgtttctatatagtatttagttaagttatcaattaatggtcttacttcttgcatagaattataattataatgccattggcgtttatctgaaggaagttttttaactatttctttaaccatttttcgcatttcaatatcttctttaaaactcatttccttctttccttgaatcaaattatctcttataagtaaatttattttatctaaatctttctgcttatctaacaaagaattaacaaaagaacttttcatattatataaagttctaggtttaaattttcctctttctctactaggatttatttcaacactagcaatatgaacatgaatattatctgtattgtagtgtagacttgctgaccatgttagatctttaaatccttctcttttacttaattcttccatagctcttctagttgcttcttgtattttttcttcatccaatgctccattttcagaatcatataatccatttgcttctaagaattcattatcaaaactaaaaacttcttgccacatattactaccattcaattgagctttatcaaaatctttttttagctttttaacttccttttcagttaaagaatgtttgtctttagtaaataaagaacctattttttcaggattacccatatagttgttatacgctgaatatttatcaaaattcttttttctagttgcttcacttctatctatatagtcaataaagttcttaaatttactgcttccatttctaataaatttaactttatttattacaccaaccataactaatattccttatcaagtttcttaactctttgactttcaattctcttatcaacttcttttttagcagttatgtaagcttcatgttctttttcttttgatggaaatatatcaggtaaatcttctgcaataaacaatccattcattaactctaatagcacttgaatattacgatctgaattattacttactctttttaaaactaaaatacttgcttttattttttcagcaactctatctcctaatatttcaatcatattctccataggaatatttaaatttttttcatgctctctaattattaattcaagagcttcactatttgacctacaagaatgttttgtttttatatcttctatatgctctatagaagcatttgataatctataatgtttttcttgtcttttcatattctattattcctccttaaaaatttcagttaaatcaatataattttcatcacaaaactttttcattacctttgtatttaaatctaaaactcttaatactttttccatagttattctataatttgcttcaaactttctcatttcatctgaatgtgatagagtttctaaatgttcttttaaaaactcatttctactcactccttttgctttcgcaaaagaatctattcttgttatcgcttctttactcaaatctcgcactaataaatctgacatttatatcactactccctttaaaaaatgaaagtattggaacttttttaaagctccaatactaaataaaagattaactttttcaaaaaagttctcaaaaacatttattgtaattgtgtactttatggtgaattggtaactacttgatatacttactttaagagcataaggagaaattgctatcacacaaggtgctagactaggcaaagcctagtatttcaatgatatcaaaacaatttccaattatcccactttaagccacaaatacgccctgttaaatcccttttttatcccactttaagccacataaaatccataaaagataccattttatttaaccattttctctaaatcttctttctttttattaagtttatctattttatcattaagctctttattatcttttttaattttttctacgtctttatttaatgaatcaacttgtccttttaaacttgttattgttgaatcagtagttgcaatttctgtttctgtttgatattctttatccttttctagtgaagttatttttgaatttgcattatctatttctttgtttttattttcaatttttatatcattatcttttatttcttttttaactttttctatttcttcattaactaattctattgttaatccttctttattttgttcttttaagttattatcaatagaaatatctcttgaatcagaataaaatttcacctttttaatttcatttgttttattgtttttatttataaaagttaatgaaactgcactccattttttctctggtaatgttgcatatataatataatcttgatctgaaactttaactaatttagtaggtattatttcatttggattattcttttctctaagctctacagacaaatttgaatctgtattaatatctaaattgtctatttttaagttaaattgtattaaatgattttcagggttatactctctatttgttacatctacatttatactatctactaaaaaaggtttatttaaatcactactaatcagattagcttctctattaaataaagcattagaagacaagaaaaatatcaatattattacaataactccacttattaagtaatatgttattgcaccattcttttgaaatttatattttaaatcatctacttttaactgcaaactttctctatccatacctattgctcccttcatatttataggaaaaaagagctttataaaatttataaagctcttaaaaatcactttacctattaaaacttctctaaaaataaaaccatttttaaatacaaaaaaggtaataaaacaaaaactaaaataaatattgaaattaatataattgttaaatttaaattcaaattagccacctcattattctattattcttcttacatttccattaaaatatctgctccaataagggctatttaaatctcctatacttacacctttcgttgaactatcatttaaaaacttcccatttcctaagtaaattccaacgtgtccatttctaccagcagtatcaaagaaaatcaaatctccacgcttcatttgttctttcggaacagactttcctaaagttaataaactccatgttgtaacactagaacgatcacctaattgtattccagcactagcataacaatagtgaactaacgaactacaatcgaatcttcctgcaataacatcagcttctgttcttccaccaccccatacataaggtgactttcctacccatttcataccagcttcaattgccttttctatagtttcattatttcctttaatacctccactattaactaatcctttgcttctaaattccatagcatacttgaatacattgttaggataattattttgtgcagtatctaaatttacactcataccataacccggacccccattataacaagcaaatattcgtcttaatatttcactaaaatttgaatcattttcatcagcgttccagttgattactttcaagttttctgtactattatactctaaggttggtacaagtttttttctgtataatacataatttgcataatgtctagtttcataagcaccagttattatttgcaatctaacatcttttaaaaacacattccaaatttcatctacactactaaacgagtaacctaactgtttataaatatcacctaaccctaaatctaagtaatatttataaatatcacttccatcaaaatcatatctttgttgttgcattattccatatgctccaccataagaatcattaggattaaaattactttcttgctttgcaattccagccaaaacccagttaggtattccagttaaatcagaagcttcattaaaatattgaacaaattctgctggtactccaccagctccaatatctgcatgactattattatttttcgagctattaatttgaaatatagccattgctaaacttccaattagaagtgttaggattaagaaagagcttgaaaaaaacattattgaatactttattattttctttatcaactccttttctttctccaaaattacacctccttctaaaaaaatgtataaaaaaaagaaactaaatcgctaaaaaacttagtttctttttttattaattttaaatttaatttttcatataatattcagttatcttccactttccatcaatttttaataacttaaaaatatatgttggtgataaatcattgtctactttttggtcatagttatctatattatcttttttaacatagcttgtaaattctaagtaattattatttgaattatcttcacaatctgaataaattttatttactatactttttttatatggatatttaccagcatcagcttttattccttgagattctaaatcaaaatttccaagagcttcaggtgttaaatatttcccaaccatgtccctatattttaacggattacttttatcaaaattcataataccttgcataaaattttcaacaactctttttgcatttaacaagtcttcatctgaaaactttccatctctaggtatataatttgcttgataaaagtttttatctccaacttgttctttagtttttactgaggttacaaatccttcaggtaaactataatagctatctgatgtttcattgttgttattttctacggtgttttctttatcacttttagcttcatttttaggtgagatttgagttgcaacattacttttagatacattatcaacttgatattttttatatcctatatacgctaatgaactaatgaaaagtacccctccaataattattgctattgtttttttcttcattattttaagctcctcccttaaataagtatttctctctatcagaaatctctatattaaatctgatatttttatccccatttattactaaaatacaatctcctgtagaaaaattaggtatcgcatttatttcagtatctgttaattgaccactaaaaatttctgacaataatccttttgtattattatcttgttgcattataaatttatattgtgttaactcaaaaagtgttcttattttttcaaaaacttctgaatttgaaacatccggaacaacatctcttatgctttgtgtagcaaatattaaaccaccaaaatactttctagcttctctttcaaagttaattaaataatcaactgctagtatgttattgctatttataattctatgtgattcatctaataatagtaaatacttcttggattcttctactgttttctttccttcatcaaatgctttcttttctggtaatccttgagttaaagcattattccaaagcatacttaatacattaaatatctgagcattaaatattcttttatcaactccagttaatgttctaatctcaaaacttactatttgctcttttgttaagtcttcaatagaagaatgtccatcaaatagtttaccataatttctgatagcattgtcaattgttaacattatactttctaatcttttctttctaaaatcacttagattttttcttatacttgctttttcttcatcttcatagaatacacctttaatataattaagaaactcacttaatgttgggtattcttcagccttataacttgtcgctttttctctttctattccatatataatataaaaatcatgtagaagtctttcaaattctcttatttcttcttgtgttgcttcaggtgatagaaaattataaatcatagaaactttagacatatgttgcatataactttgttctacttgtacctcatttgtattttcattaatcatagttgcaaagatttgtaatggatttatcattccattactaccatctaatgctactatttttccttctagctcattaactaagtctttaaactctcctgttatatctagtattcttaatgtgttatttactattgcattgttattgcttaatttttttaataaagttgatttacctgatcccataacccctattgctaacgcattataagattttctttgttcattcttagtaaacaaatcaaagataacatttcctcctgtaatacttgttcccatgaacattccagttggatcatttagttctacgtagtgaaatgggtaaccagctcctaagcttatactaggcacaggatgtccacttcttttgtttcttaaatatttttgttcaccagcacttaaaaataaagatttccactcatattcttgttcatttagaaaaactgctcccctataacctaacccttcaagtttagttaatacttgtttaattttttcttctaactctatttcagttttagcagataaataatatctaatagttactaactttattacttcatcccttgatgtaatatcatttactaaccccattagaatacttgttgcattatttgcttctataatatcaatgttattcttcaaactattagccctatctacattctcgcttatagcactatttaaactttgtaaagccttacttctatcttcagtttcaacatcaatagttactgttacatcttttatatcgatcaacttacctaaccaaaattcatcaacagatgttgggaaatcataaattcttaaacacgcttcatagccatcacccttaacaatacttctaggattaaactttattccacctactggctgaattttattgaaaaaatagggattataattataatcccttttaaatatacccatattaaattcctcactttctacttactaaaatctaatttatagttaacatacttcccagtatcatttaaactaacaaaagcatcataagtaccgttaccatctttcttttttaaacctgtcattttcactttctttccagctaaaagatttttagcaattgactttgtaaccttcttccctttatccttaaaaaacttatcttctttccaaatattaaactgacactttggttcatctttataaccttcacatgaaaatgattttgatgtttcatatatattcttgccacaacgaggacatttccctataacttctttttcttcctttattgcttcaatctctatatttttactatcttctaaaattgattttaattcattagaaattaagtcaactgctctatctatatttaattcatttttatatacctttttaagtattcgtgaaaattctactgttttttctttagataaatttacattcaatttatctaatgtttctattaattttcttcctaatggttctatagatagaactgatttattttcagatatatatttatactttttagcattttcaataattccagttctagttgcttctgtacctatttctaatccatctaaaatagctttatagtcttcttcttcattttctatctcataattcttaaaaggatttttaaggtaattactaagcatttctgttgtcattttacctggtgcttgtgtcactttttctattgctttaaaattagtatttatcttatctccgacattaagattaggaagtgtattttcatctttcttaataggctcatattctaaaaatcctttttgaactatgacatctccttttaatgaaaattctaaatctccaacttctattcttattattgttctatcaatcaatgtttcttctattaaaaaatttgaaataaatctatttttaatagtattataaacatctaacatcttaccctttaattcatcttctttaggtatctttacagtaggggtaatggcactatgactttctatcttactatcatcaaatatggttttcttatctttaaactctaaattatacccttctgaacataaaatatctattatttcttttaccttacctttttctgcttcagctagatattctgtattagttctaggatatgttacaaaccctttttcatatagtttttgaattaactctaaactttctttaaaagtcattttatattttttacttaaaagactttgaagtttacttaaagaaaataacttactaggttgtttcttaacttttttagtatctttacttataactatagcttcataagtattcagttcatctgcaaagctcttagctttaataaattcacttttagtaaaagcaagttctttaactactaatttaattatttcatcattagttttctcattactttcaatttgataatatgtttcaggaacaaagttctctatgcttttatctctctcatatatagcttgtactataggtactaatacccttcctacaggaaataaatgcttagattttacagtaacatatcttgtaagattaactcctacaagccagtctaaaaatgtccttgtaaatccttcatttgcaagattattataagtgtctatatcttttaagttatttaatccatataatatagattgtgttgtttgctctggcaaccataatctagttacttttttatttatactattattattaaaaacattatttattataagcctaataataacctcaccttctcgatctgcatcaccacaagccactatttcatctactctattactttttattaattcttctaaaatcttatattgttttttaactccgacatcatcttttatactaaatttaaactctttaggaataaaaggaagtatatcatttctccactttgctcccttatcctcacctgtgtactcttctatattataaagcttaaatagatgaccaaaagcaaaacttataatataattctcactttcaaaataaccatctttcctctcaaaactctcgcttgaatttaaagcttttactatattcattgctaaacttggtttttcagctattactaattttttcacaattccaccctccttatttgttatgaatattcttaactattttttacataagctttgtattcatattattaagtttaaaaagtatcttcatttttttctctaaatttatatttttcaaagtgattgatatattctgcatatgatttaacttattaagtagattttctttatcaacttcatttttcataaataccattaagaaaaattctttattgtttctatgagtttctaaaaatttaagttcatttaacttttcttccaaaaatccaatatatttttgattatcggtttcttctaatttcttattcaaatattcttgttgcttaactgtatttactggaaaattcatagctataatcttaaaatcatcaatataatttcttagaaaatgtataaaattatatatatataacatagtttcatattcagataaatttgatacatctctagtctttacttgatataaatttaaaaaaccttgttttgtcacaaaaaaattatcttcatcaacatctaagaacggtaaaacttccctattgcttattaatgtatttttactttctttcttcttttctttaagctcttttttttctttagtcttttcttcttttaatttaaccttttcttctttactaagtttaactttttcttttttatttacaattttaatattttcaaactttttcaaaatatcacctcatttgaatataaaaaagtgtcccccggggacacttttaaaattaagttaaataaaacatcttatctgctattcagtaacttcatagctgctaaaatattttattcaactttttctgctacataaacttttttatctctcaccaaagcaagataaactgtttggaaattcctttttttagggtttataatactcttattaactaaaaatatagttgatatcgcaacaaatatataaaaaagaactcttaaactaggataaaccaatccactaaatatagtagcaaaaattaatgctactaagagcattgcaaaatcaaacagataaatctttgatgtaaacttcatttctgtagaaatttcttttggaatattatattgcatttctaattatctcccttcattttattatttttcttatcttttaaatttttataattcttaggtatattaaatctttccgttgcactttgacctagtttataagcttgttttatttccctactcttgcgagttgcaaaattttcttttgtatttacttgtctaaatgatccttgattaaaagcattattcccagtattaacattactgttttctctattgtccatactttcatttacaggattactcttaggatttgtacttctaaaatcactatttccgtttatatttctattcatttcatcatttaattttccacctgagcttaattcttctttaccactcatctctgattgtaaattctcatttggtgagttatttacctgacttctcaaatcattattaaggcttccatttttcatttcatcctgaagtgaagagttatcatttttaatgttatctgcacctttcatttcttcttgtaaattcggaattatatttctatttgcttctttactcatttcttcttgtaaatttggactattacttttacttgtttctttattcatttcttcatttaatttcggattatcattatttttattatttaatccattcatttcatcttgaagtgtttcagtagtttctacgcttaaatttttcatatcatcatgtaatttagcactattttcaatattagaattattaaagtctttttcatttgactttttatcattattcatttctgattgtaaatcctgcttattgttattcttatctgaagaatttatatttttatcaatatttgcattagaattagcatttgcatttttcatttcattttgtaagctacttgatttattttcagtttcattatcattagttcctgaagagctagttttgtttttaaacaatccattcatagcaccagctccaactgctccaccttttattgctgaatctactgttccaccagttgcttttgcaaatcctttagttcctgaaatcatactcttagttccagagcctaaagctttcatagctccatatgttccaagcattgtatttaatccactctttaatccagcatctattcctaatattctttctattatatttggaccatctataactgcaaaagaagctcctatttgaagaattaattttgctaaacttgttactgtgaatccaattcctgtatcaactgaagaagcggtaaagttaagccatgccacaaatataatatataatttaagcaatactgccgttgccattataactgcaaaagttgaaaaaatattttttaatatagcctttatttttttattatcttctatatctgcaaaagcaaaaagcatagcaaataatttattaaaagctaactcaaaaatcagtcttgctattttaaatcccacacaaagtagtgttattcctgtagttgctaacccaataataacactaacaaaatctatattatatctgtaatagtcttcatccatcataatccaatttttctcaagatctgtttccttcatatctccattagctaatgtatctaattttttcttaaaaatttcttcatgctttgttttactatcaactttaaatgcttcgtctatatgaatatcaaaaatattatctattgtaatattatttttttctttaaaattaaaatcattttggtctaatgcgtaaagatcatatagattatcttttactatttgtttagctgaagaagtatatccagctttaacatcttttactaccaaatttgttaaatctcccattttaaccataagcattggaagagctataacaacaattaatgaaaagattaaattggtaggaatactttgtttgtccatttttctattcattattattttatagcctaatactgctaatgaaatagctaatatagaccagataataggtttatatctatctataaaattatttacttctgaactcgaaaaaaatgaattaagagtatatattttatttactgctccttctacgccatcaactaaagaagctaataaccatataatttgccatcctaaccatctaaatgcgtgactaattatacctgttatactcaaaatacccatttcagttaattctattaaagtcacttttcttcacctcctgtaacttttttagcttttagaatatttaaaattttattatattcttctaaatgtttacttccttcaaagttatataacttttcaaattcactaaaaggagtatctttattaaattttatatctcttaattccctaaacctattattataagtatttaacttcataataaatgagtagtctaagaactcacctaaagtaatatctttttcactacaataaatttcagtttcattagccttttcttcaaaattttcaatgcaatcttctttaatagtatttatatcttcatttacatttaaatttctatcataagcacttataatattattcaactgcttatctattttacttatatattcatctttactttcattaaaatctattaataagctatctaagtctaaatttctatgtttactttttatttttatatttttaaatacattttcattattaaaatcttcacttaaatattcatatctatatttaaatgcagtttcaccatgattataaattggatttggaactattttacttcttttcaaatcttgtctttttataacccttaatacaactgtttctccttctttaaatttctttaattcttcaggaagtaaaagtcttctactatcaacactttctgttctatttttagttatatccagtatctctcctgatcttgattgattaactattgttttatctcctaaagattttgatatttcttcagcagtatcattatcatttgtcaaaatataaataacatttccacagttaccaacaattgttttttcatcttcaccatataatttttttaattgagaataagcttgaattatcatattaaatcttattcttctacctaaacaaacagtagttaatgttcccattccttctattggtggcatatttccaaattcatctaatataaaaataacttctctttcacattttgcagtatcgaatagagaagcctcctttgataaaacataataaagttgccttataaaaatactagctaatacatgattagaaccatcataatcaggagttaccataaatagagctattggtttattgtcataatcagtatcaagaaccctaaacttaattatatattctcctacttcatttacatctaaatcagaagtatcaacttctataccctttataatttcattacctttacttccaaaagctctaatctcttctataaatctatcttcattgggttcataacctttcattatttctactttttctaacccactaaaagctcctatacattcacttatattagttttaataaaatttatttttttatcatcttctaatttttctttaacttctacttttactactttttcaatatatctactaaatccaacttcttttaaattaatagaatttttagcagtcattttagctatactgctcattgtaaaacgtgaaagctctgccatagcgacagcaaaaatacttcctctagcacttccatcggcaaatttacttgtagcatattgcattttagctaccgaattagctggtaagctttgaaaataattgtctaacttattaccatcatcatctgtatctcctccaagttcagaaagcatattagctactgtatatagagttatctttgaattttcttctttttttctcttttctaattctttaatagcttctttatgtgcttcaattttattatttataatttttatttcttcagtattttcaacttcattaatcttatttcttaattcatttatcttattttcaaaatcttttattttcacatctaatattttgcatttattaagacattcatctattatcgctaaaatcaacccattgacaagtgtcattgctgaattttgccaaaatgggtctttagcagaaggattataatacaaagcatatgttaatgttttacacaaattttgagcttcgtctaattcacctttttcataagcatctattataagttgtaacggattataacttattgaatttaaaggatttaataagtttaacacttcaactctgtatcctcgtttttctagtgtatctttagacatagctactaattcaccctttggatcattcaaaaccatagaagcttgttcttcagccctagaataaatatctattaatggaactacaaacatttctcctttaccacttctagtagtacctataattaaattatttactggacttgtatcaatataaattttatctttatgtctagaaattggaactccacctccccctttaaacccttcttttttttctggaacttctttgtattgtgcttttatttcttctagtgtagtaaaacggctagtccctttttgaccatcttctaagctaataaaagattttttcaaatcaaatacaagctttaaaattggtatacataaaacaatataaattaataaataaaaaagtggatatttaaaaatcaaagttatattaaacatactttttaaaacactaaaactagaaatagtatctgaattaaaagatgttaaagtagtaaaagctcctacaattatatttactattatagttacagctaataaaatgcttaatgttaatgtaacaagtgttttattactagaaacaaatctacctaaattaaatttttcatttttgtatttttcattgcttctaagttcattagatattgtattttttaagttactaaaaaagctcattaattatcctccttttcttaaattttaaagtctttataatcctttgttttttatagaatctataccaaaaccttacacataagcgtttatcattatatagttcatttaatactctaagttctttatcactcttaaattccataatattcataattgattttcttaaaaattcatctaaaaatgaaaatatactatccataaactcactctttcattttttttaattaagtaaagaccttatattaaaggtctttactttttaaatcttaaaatgttattttactttgtaagaaactagctatagctgaagctcctagaattattattaatcctataccagctcctatataccacggtcttgcctttctacctccttcattccctccaaatatttgaaagaatccacctataccaaaagctaaggctgctgccggagttcctaaaatttgtagccattttactgcttcattaagtaaattttttatttggtcaattacatccatatttaattctccttttcactaaaaaatttaaaataaaaaaagcgtttttaataaaaacgctttttattctccactattaccttctaattctttttttaaagctaacccctcatttaaaagctctaaattttcaaatataagcttcatatgagcttcttctaaccatgtgtcataacttatacctttactctctaaaatcatgcttacagtttctttaattggatttttaacattatttctattatttcctctagccaattacatcaccccctttcaaagctttacttttagcaacaaagcatctattcatttttgtacttatttgctctctaatcatattcataaattcaaaaggagttggttttgtttgtggttcgataaacttatattcacctatgcttttattttttaaccttccttgccaatatgcaacatccaatgaatatctaatagacctatatattgaactatatgtactatctaatatttcagcaattttttcatataattttgttgctttgtttctatattcaatattattaactaataaaattactcctatctttatagcttcaaagctccttttatatggagtaataaattcagaaaggagttcattaacttctttttctaaactaaactctccaatttctatactattttcaatataaaatttaataactttatcttgtcctttatccacattcaaaacctcactttatcaatttaaattcttttctttaattatgtatctgttaatcaatttaactcacacctttatttaagctaaaatatatctattttcgatattctcaaaatcattaaataattttacctttaagtatcaatctctctttagctctgtttatacaagttattactgttatttcttttttagatatatcttgagttaatagactagaatcacttggatttactataactctttctgttaatttatacttgtaaatattattgtcagttttaatttctataatatcaccaatttttactttatataaatttttaaatatagaacctttcatattattatgtccagctagaataacatttcctacttgtccaaaattagcactatttctatactttgctacaacataatctaagttttcttctccatctacaataggagctttaagtcctatactttttatttctaaaattccaattacatttgttcttttactatttatagtttcttctttatattcaaattcattagatatcttattttcgatattatcattttctttttcaatagaattatctatactagaattattttcataattacttataagatcatttttaatattattatctttataatctatataagaagcaactgatattaaacttattcctattagtattaatattactaagatttttttcattttattttcttaattcttcctttgctaattttgccataataatatctgctctctttgctcctttaaataattctatataaatacaatcaagtaaaaataatatcaaaataatcatagttactaacactataatctcacttccttttcaaataacctaaaaaaaagtgtcccccggggacacttttaattactttgtaatttaaatcatattttaaaaggtgtcccccggggacacctttatcttattatgataattttctcttcttagtgaaaaataatccaccaatacctccagcaactaaaagaatacctaaaggaattaatgaatttatatcaaatctacttccagttttaacaatttcaatctttttatttgtaagattgcatgtaattatatctccttgattagttatttcaaactcaccagtttcagttgttaattcatatccttcaggagctttagtttcagaaattctatacttaccttttgcaagagtaaatttattaccttctttgctagaagtaaactctattactttcccttgatccaatccttcaaggcactctatttttatcttagctccttctaaaacttctccagtagcaacatctgttttagtaaactctaaaactccagttgttctttcatctttaagattagcttttgtgatttctccgtcttttatttcaaatgttccaacttctttatttatttcatatccattaggagctgaaatttcttcaaatgtgtattttccttcgtctaaagtaaatttatttccatctttgaaagaagtaaactctattacttttccttttgataagccttctacacaaattatttttatcttagccccctcaattattctaccatcagtaacatctgtcttagtgaactctaaatcaccttgttttctttcatctttaagattagcctttgtgatttctccgtcttttatttcaaatgttccaacttctttatttattctatatccattaggagctgaagtttcttcaaatgtgtactttccttcatctaaagtaaatttatttccatcttttgaagaagtaaaatctattacttttccttttgataaaccttcggtgcaagttatttttatcttagcaccttcaataactttaccagttgtaacatctgtcttagtaaagattaaatcaccttgctttctttcatctttaagattagcctttgtgatttgtccatcttttatttcaaatgttccaacttctttatttattctatatccttcaggagctaatgtttcttcaaatgtgtatttcccttcaggaagtgtgaatttgttaccttctttagaagaagtaaactctatgtttatatgcttgttttgtggttctaatcctgtaattttaaccttagcaccatctatagaatctccagtagtaacatctgtcttactaaagtctaattctccagtttttactgtattggcaacatctattttttctaattgtccatctttataaatattaaagtcatattttttatcaactttgttgtaatgatctattgcttctacttctacccaagtgtagttaccagcttctaaattattaactgttatcttaccagtattatctgtagtataagttcctacttttttatcaccatttaataagtcaaacttaactccttctagtggtctattagtatctttatcgaacttaaataactctacagaaccccttatctttttattggtcatttgaagtttaatagtttttccattttctttaacactaaagaatataggctctttatttagtacgtaattccataaagttttaacttcgtctacacggtaatcaccatattctaagccttttaaactaactaatcctttatcatcactctttaagttccaagttttccccttcataaagccatctaatgcagtaactttaaattcaatgttttctaaaggtttattagtttctttatctaactttaaaagctccatattcgctgttatacggtcattagataccttttgagtataaatagtacctaaatcttttatttcttctaaaactgagttttcatctattttaaaaggtataggattaactttaatatatccttctaatggttcaacttcttcaagaagataatttccataagctaaattttgtggagttactaattcaccgtttttattagtttctaaagttgtagttttcattggaattatacctatgaagtttgtaaactctaccaactttttagtgtcagcatttcttatttgaaacttaactccttttaatggctttccatctttagaatcaacctttataactctaactttggcttgtataggagagttcttaatgtatttaacataagtttttccattttcagctatattgaatgaatactctttatcagacttccagtatccttttggagtatctgtttcatggaacttataatctccatatctaaggtctttagtataagcaaatccatttttatctgtaacaacatgatctacaacagttccttctttgataccattaacattaactgctataacatcaaatccagcaccttcaactggtttttcttcattttcactatcaaccttaactatttgtaattttccctttataacatcattactaacatcaaaagtataagttttatcattttcatttatatttatatcccatactttattacttaataaatatcctttaggggctttagtttcttgcatagtgtaagttccataatttaaaggttcgctttcagcatagccgtctttatttgtagttatagttgctactatatttttgttattatcataaatagtaaattcagcaccttctaaatttaaatcagatatttcactatctgttttcttaactgctactttaccttttataattttgtttgtatgagttatttcaatagtcttaccattttctgaaatagtaactggatgttcttctccgtttaaaacatatttagatggagctttaatttccttaactaaatagtttccaaaaggaagtaagctacttgtagcaataccattttctccagtagttatagtttcaatatgcttaccatcttgagttatttcaaattcagctccttgtaatggagtatttgtttcttcatcaactttaagaacttgaattttacctttaatttgagtatcagtcatttcagctatagaaaccttattcggttttacagtaacattaactggattagtaactaaatagccttgtggagcttcaacttcatgtatagtgtattctgctggtttaatatcattaaatactgctttaccatcttgtgaagttgcttctgcaacattttcatcattagcatttttaagaacaaatttagcacctgttaaaagtttaccatcatcaccttttttaataacttgtactgctccatttaatccagtccaagaaacttttatattatctttatccatagaatgagtatctaaagatgaaacagccatatcttgtataccttgttcaggagtcatatatcctaacattgctggtatatcaacctttgcttttacacttacctttaaatctcctgtttctgcatttgaaggaatatatactctaaaactttcatttgccttatatcctgaatctttaacatttccatccatatcttttatgactatatcttttgttaactcaggattacttgcactttttatagtaacctttacaccacttaaagtatagttagactttatttttattggttcactaacaaaatagtcaccttcttgatgtgcaattatatcatttggtgacacttcaaaaaaagtaggcatttctttattatgagctttatcaactaaaaaatctattactggttttaatttacttaatggtacagtaccactttgaagtctttctctaactaatcccctacttaaaccagcttccttctgataagcccatatagctaattgagtacaatatctatattcatctgctgatattccccaatctgatccatcctttgctggatatccccaataaagaattgtttctataccagcatcaacttgcatttcttttgtatagtcttgaccagttggatttaatgcacctgtatttaaacaataacaagttgttaaatctccaggaacataatacctatgatttcctattggaagaaccttcccccaagttggagaatcataatttaaatagctctctgcatcagtagaagttatttctactgcaaatacctttatgttagtaaataaaaaagtaaaaattagtgtgattgttgtgattaatttaaatctttttgctttgctcacctttttccctccatttttttgttttcatttttttatttttgataaaaaattttaggatgtatcaaagtaatccacttaatcttctccttcctaaaaaattgtatttaaaaagagtgctgcctaattgcaacactcttaaatatcctaaattaaacctaagcttattactaaagctctattcaatctttttatttcattattagttagagttcctttcttctcactcaactgatgtctatatatagtagtaatttgttctaataaaattgtagaaggcttttctagacaagaattttcaatttctgtatgaaccttcatcttatttttaacttgagaagtcataggtgctactacaaaagagcttccaaagttttgaagaatagctactggtctaataccttgttgttctgaaccctgttttctttttcctaaattagcgtaaaaaatatcacctttataaactttacctttataaaaatttcttttaaacttcaatataatctccaccctaaaaactatattaaaaaagacttagataaatctaagccttttatatataacctttttaaaaagtgtcccccggggacactttcaattactttataattttaatgacatttaataatcaaatcctattgcaaaataatatccaccatcagcactcttatatactgcacaagctccttctgtaagctcatcatctaaaatattcttattatgtgcaggagaatttttaaattgttgtaatatttcacttgcagttaaatttttatttgaattacttccagtaacttgtcccccttcaggataatcaacatgataacttccagtattctttttagccatttcttctacatggttctttgtccatgtagcatatttaccactccaactcaaagcatttaatcctttagattgtctataagcattaaaatcactccataactgttgactcatatctgccatgtattgaacatttttaggttgttctactggtttttcagtaggcttttctactggtttttcaacaggtttggaaggttgtggagtttcttcaggttgctctgctggttgttcttctttttcgttattttcaggtttactttcaggcttattctcagaagaactgtctggcttattattttcagtattctcaggcttattttcaggttttacaattgttattgttccttctccagtagcagtaacatccttaatatcctccactttttcaacctttcctgttttatcattttttattgtaatactgcttccagcatcttttttagagttaatgacttttttcacatcatcacccttactactatcagcaataatattacctgttttttgatccttaacaattacatttccatcttttgtttgttcaacttcaatcccatcttcaggtgttgatttattagcttcactttcattagtagcttcatcattagtagcttcagcttcatctgttttagttgattcatctgttttaatattatctttattagcttctttagtatcattaattttctctgataatgcagtattattagttttattatatgtatttgataaaattgagtaacttacgccacctgtaattgctattgctaaagcaactgcaactccaatgcttgtttttttatgctcttttataactctcattaattcttttaattttttactcattttacactctcccataaattatttcttcaaaattaaattttcttactaatttaatttatccctattttttctactataaaaacttaatacttctaatttaatctcttcatcttttaagtttttatattctatttctttattttcatttattagttttctaggagtatcaaaagaaactgaacaccctatttcactttcatcttttaaaactatatcaccatttcttttagtgttataaatacttctattttttagaataaaagctttatctccaatctcttttttagcttcatagtctattgctttcctcgtatcccttctactaaaagaagcttgtctatgtattttcctaattctttctctattaggagctggtaaactatcaatccaatttttaactattcccttaattgtattttcactcataaacataattcttcctatgtctttataagtataaccagcattatataagtccattatctctaattgtcttttttcatgttcacttaattcatctaaaattctcaataaaagacccccttatataatttttaaaaaagtatatagttcaacctaaccaaaaaaggttgtccaactttttaaattttatcaatttatgtacttctaaagaaattatgtactttagaagaaatttatgtaaatgtactttatgcttttataatacatttttcaaaaagttttgtcaataaaaacaacatttatatattgatatattttatttttattttatatatctatataaaaatatttttaaatattcttatataatcacatccaggtgtattttctctctatttatgctaaaaatgtttgtaggaggtgattactatagattggagcaaattttctgaaaatctaaaagaatatagaaaaaaacaaaaattgactcaagaagatttagctaaaaaaataggtgttgctcgtagtacattaagttattatgaacatggtagtatagaacctaatatatttgttctaataactctttcaaaattaatgaactgctctattgatagtttaattggattatctaatgaaaaaataatccctattccttctacagatattaaaaataattatgatacaaaagaaagtgagaaaactaatgaagaaaataatttagaaattcaaaaaataaaacaagaatcaaaaaaaatattagaaaaagctaaaagaagtttttctgaattagaaatggcaaaaaaacgtactgataagatgtatgaagattttataatggcaaaaaaacgtgctgatagaatgtataatgaatttgaaatatccaaaagacaagtagaacgaattattaatcaatttgaagtttcaaaaaaaagaactgataaaatgttcgaagacctagaaatgtccaaaaaaaggacagatagaatgtatgaagagttatttagaactcttaacagagaaaaaattataaatgattcaattttgaagattaaaaacttatcaaaagaaaataaattagaactattaaaagaaaaagctaaagaaaataactacgaagaatttaccaaattaaaaattttaggcaaaatctcagctggaatacctcattatgcctgtgaagatttaattgatactatttatttaccaaatcaattctttaaacctaattttgaatactttggattaagaatatttggcgatagtatgaataaaatgtttgataacgattttacaataatagttagaaaaactaatagtttcataaatggcgatatagttgtagctataattggtgatgaagctacttgtaaggaaataaagcaagtagaaaattacatatatttaataccacatagtacgaatcctgaacatcaaatacaaaaatataaagcagatcaggttatgattttaggtgtggttgaacaaacaataaaaagtatactagataaaatagatatttagttttaaaaatttatattaatatttacataattacatgtaattatagttatatgattacatgtaattataattatataaagactaaaaatttaaaatagataaatatattcaatctattcaataacccttaatttttttatgtttaacgcctcaacacattcatataaatatctatatattgcttctttactttctaaacttatgctatttgggtctatattcctattaaacattatattattccaacactcttctataaatttatctaaattcaaatttttaaatttatttttatttttaaatccattattactttctaaatatactttcattgcagtgtaccaatcatactcagcaccttcatttttagataaaaaagaaaaataatcttcttctaaagcaaaatctaaacaatctgaaaaatcatagagcatttctttactattaattttttcattatgaaatttatttattgcttcttttactgaattagctttaactataatagtcgtaaattcacttaaaggcatattattataattaattatgaattctttcatcaaaacacctcttcattaaaaactatttttattctgtccaccctaataactgctcctctaattttttataatcttgatctctttgtgtgaagttagcatgaggacttgtctttttattatttatgttaaattcaacttttttaattttatccatatcatttaaagttgctaaaatataccccttaaaatttttaattttagtatcagtagcactagctgttagtattgctttagctattttattaaaatcatatatagttaataaatctttaatatcatttttctttaatttaaacttattattctggcatatttgtaataactgaataatttgttttttatcttcttcatcaacttctttagaagaagaagaaatattattgttattattaatactgttactattaatactgatactattacttcccacattttgaacgctgtcattttgagagctgtcattttgactgttctcagaaaaactagtattcatgctatttttctcagcactgtcattttgactgttctcagaaatattatttttattattagtttttatcttatctttttgaatttcttctttaggttttggtgttgggaattgttctaaagtatagatatttttatcatttacaactttacctgattctaatttagttctagtttgttttattgtgatataaccaagatcttctaaaagttttctatgtttataatatctttttcactaatacataactcacttaattg

SEQ ID NO: 27 - DNA, 47263 bp, Clostridium perfringens
ttgaaaaaaaataaaaaaaaatatataatgtagttatgctaaaatataaacatgaaaaatataaatgtaaaggtgttgtaaatatgcgcaaagaggtaatttttaattaaattaactgaataaggattatttttaaaagtatatgaaaaatcttgaataactcaaggtttatttgtggtggaatcaattatttataatattgatattaccatgtttatttgtgtactctaaaaataatcagtattataatgagcatgttacatctttatttgcaggataggaaaaccgtgttctaaacacggtatttttatgtctatttttgctatatatagatatggtataagattttaatttgaatagcttaatcataagttatataattaaagttctatattttatgtttatatttaggttatatgattatgaggctgtaagtgaattatgttcatttacagctttttttgtttaaggagattattttgatgatttatatatttaaatatgaagattatgaaaaacaaacaaattttttaagaaatactaggatggtgatgattaatggttaataaactttcagcatataaaacttatttattattttcagctattacagcaatgtgtttttcgttagtagctacagttatgatggtgtatcacattgaaatagttcatttaaatccacttcagcttatacttgttggaactactttggaattagcatgctttatatttgaaattcctacagctatagttgcagatgtgtatagtcgtaaactatctattgttattgggggagttttaacaggagtgggatttattttagaaggttctatttctagttttgttttcgtacttgtagcacagattgtatggggattagggtctacttttatcagtggctcgcttgaagcttggattgcggaagaagagaagaataaagatttagatgaaatttatataaagggagcacaagcagggcagataggagcatttattggaatagtactaagcactgtaatagctaatttctctgtaaggcttcctattatagttagtggagttttatttataattcttgcattatttttatggttatatatgccagaaaataattttaaaccatctgctcctggggatttaaatacattcaaaaagatggtatatacatttaaatctggtcttaaatttgtaaaaagtaaatctataattatgattttacttgcagtaactttattttatggattatcaagtgaaggttatgatagactttctaatgcgcattttttacaagatactacacttcctaaacttggaaaccttagttcagtgacttggtttggaatttttggaattttaggaatgatattgagcttcatagtaatgcattttatggcaaagaatcttaagaatgaggataataggaaaaatggaaaactattattatgcataaatatactttatatatcgtctatgttgatatttgctcttacaagaaactttagtttaatgttaatagcttatttggcaacaaatacctttagaattataaataaacctatattcagtgcgtggttaaatgggcatatagatgataattctagagctactgtgctttctataaatggacaaatgaattccttaggtcaaattttaggtggaccgattataggaatcatagctacaaatatttcagtaagtattggtatagtatgtacttcgttattagtaacaccggtattagtgttatatattgttgctatgataattgataaaaaggtggatgatagagttggaggtattgattatgaagaaaataattaatataggaatcgtagcacacgtggatgcaggaaaaacaactataacagaaaacttattatattatagtggagctataaaatcagttggaagagttgatttaggcaatacacagacggattctatggagcttgagcgtaagagaggaattaccattaaatcgtcaaccatatcttttaattggaataatgttaaggtgaatattattgatactccaggacatgtggattttatttcggaagttgaacgttcattaaatagcttagatggagcaatactagttatatcaggagtagaggggattcagtcacaaacaagaatattatttgacacattaaaggagttaaatattccaacaataatttttgtaaataagctagatagaattggggcaaatttcaacaaagtatttgaagaaataaagaagaatatgtccaataaagtagttagattacaagaagtatatgatgtaggaagcaaagctgtttatataaaaaaactatttgatacatgcataataaatgatgatgctattaatgttttatcagacttagacgaagcatttttagaaagatatattggtggaatagaacctgataaagaagaaatacaagaaaagctttcattatatgcaagagaaggaagtctatatccagtattttgtggtgctgcagcaattggacttggaattgaagatttattagatggaatttgtagttattttccatttgcaagtaatgattgtgaaagtgatttatctggggtagtatttaaaatcgaaagaacaagtaaaaatgaaaagaaggtttatgtaagattatttggaggaaaaatatctgtaagagataaaattcaagtacctaataaggagatagcagaaaaagtaaagaaaattaataggttagaaaatgggggagttgttgaagcacagaggatagaagcaggggatataggtattttatatggacttacaagtttccaagtgggagatgttattggaatttcaaatgataaaattaaaaatatatctatagctaaaccagcattaaaaacaacaatttctgcaattgataaagaaaaaaatccagagctatttaaagcattaacattacttgcagaggaagatccactactcgccttcgcgatgaatgacatagataaagaaatttatgtcaacttattcggtgaagttcaaatggaaatactaagttccatgttagatgatttatatggaataaaagtagagttttcgaatattgagactatctataaggaaacacctaaaggttttggagcgtcaataatgcatatgcaggaagacttaaatccattttgggcgacagtaggcttagaaatagaaccagcagggagaggcgaaggtcttaggtatatttctaatgtttcagtagggtcattgccaaaatcttttcaaaatgcaattgaagaagcagttattaagacaagtaaacaaggattatttggatgggaggttacagatgtaaaagtcactcttagctgtggtgaattttttagtccagccagcactccagcagattttagaaatgtgacacctatggtattcatggaagcattatataaagcacaaactgttttattagagccattacatgagtttgagttaaagattcctcaaaatgctttaagcaaagcggtatgggatttagaaactatgagggcaacctttgataatcctattgttataggggatgaattctcaataaagggattaattccagtagaaaattcaaaagaatataaaatgaaaatagcttcatatacagaaggtagaggaatgtttgtgacaaaattttatgggtataaggaagcttcagctgaattttcaaaagcacgcaaaaaaacaacgtatgatccattgaataaaaaagagtatttgcttcataaactaaacgcaattagagattaaatttaaatagataagttaaatttttatatgtaggatttaaatataagacattcaaagcctaaaagtaaaggaagggtcgtctgaagaagatgaagacccttccttttttcatgttactatgcttaattgtaagtgcttgaaatttgtaatataatgtaaataaagtttttaataataaggggacggcacaaatgaaaatcgactttaaaataacaaaagatgactatataagcttcaatttaaatcatttagaaaactcgaaatcacagaaaagtacatttaacatacttagatatgctgtacccatagtactttctataccaatctactttacaggaacggggatatttaatcaaccgagtatatattggattatagtagcgatagtttttttagtcatttgtattttaacatatcctaagcaatacaaaaaattagtagctaaagaaactgataaactcataagttaaggagataattcatcaatatttggaagtaagactttagaaattattgatgggacaatagtagtaaaaggggattctatatcagaaacagtatcgttagaaagtataaaagatgtaaaagtttacgaagatatgatccttatatataagtggatttgtagctcatataattccaaggagatatttagataaagaaatagagaaagaacttatgaaagagcttaaaaaatgtaaggctttagaacaattaaagtaaaacgtgctcctttggaggtgtaacagagaaccgtaccacaagtaaggtagcgcggatgataagaataaaaatttatatatataatttagatcttagttatacttaaaaaataattagtacgataatatatgtatagataatatcgataaaagtatattactaaaaattataattgttagtatgaggagtgattatacatggatatgcttaccaatttcaataaagttatggagtatatagaaacgcatttagaagaagaaatagactttaatatggtttcaaagattgcaggagtatctgagtatcattttagaaagatgttttcgtatctttcaggtatgacactttcgagttatataagaaaaagaaggctatctaaagcaagttttgatttaatgcaaaaagatataaaaataattgatatagctataaaatatggatatgattcagcagatggatttagtagggcatttaaagaatggtttggtgtgaatccttcagagattaaagatgctaagaatcttaaagtatttccttgtatgacttttcaattaactattaaaggaggaagtaatatgaattatcgtattgaaaaaaaagaagcttttaaattagtaggagttaaaggtcaagttcctattgtgtttgaaggtataaatcaagaaataatgaaaatagcacaaagtataacagaagaacaaagaaaattattacaatcatatagaaatgaagatgttaaaactgttgttaacgcttcatttgattttgatgataaaaggtatgaagaaaaaggtaacttaaatcacttaattggatctataactactttagatatagattttggtgaatttgatgttgtagaagttcctgcttgtacttgggcaatttttccttgtaaaggaccatttccaactgtatttcaagatacatggggaaaaattttatctgaatggttgccatcttcaaattatgaattaataaacgttccagaaatatctttcaatagagatatgtcagatatgcaaaatgtttatagcgaaatttggattggggtaaaagaaaagtaattagaactgaaattttattctatatcacagttaaaggtaccttgaataaattaaggtgccttttgatacttatttagaataactattaaggaaccttatcataaataaatgagtttttttgtaaagtattgatattacttcaatagtagctattttatttcagaaagtatagtatcataatcaataattaagtattaagaaaattagattcaataaatctaaatataactgataattagtaaaatatataagtaaataagtattctaatcagtgtattaaatttggatatttttatatagaaagtattgttaataatgaaactatacttaaaataaggtaaagataacatggttaaataccaaatattgtgttaattttaattatttataaaaataattaaaaaaaggttgcaattaattaaatactatgttattataaaagagtagcaaagttgctaacaaaaaaagtttcatttaggtaaatagtttctcgaaaattagagattattatatcaatttagaatctttaattttaggaggaatgtttatgtcagataaaacattaaaatgcagagattgtggaagtgaattcgtattttcagtaggagaacaagaattctacaaagaaaaaggatttgaaaatgagccaacaagatgtatatcttgtagaagagctaagaaagaacaaaatagaagataattttagattgttataggttgtagtttaaactacaaccttttttagtataaaaaaataaaataactattgtaaaaacctcacttaatgctgatacggagaaccgtatcacaagtaagtgcgaactttaccaaaattggatatataaatgaaaggtaggtctgctttaattctgcaatgaaactcacaaaaatctaaaatttgaatttttgtaggttattgtagttttattcataggttcttcgtttttcacctatttcagcaaattagaatttgttttttctaatctatagtattgaaaaaaataaaagtttatatataatgtaattatactaaaatataaacatgaaaaatataaatgtaaaggagatgtaaatatgcgcaaagagttagtttttaactaaactaactgaataaggattattttaaaaagtatatgaaaaaaatcttggataactcaaggtttatttgtggtagaaacaattattaataatattgatattaccatgtctatttgtgtactctaaaaataatcagtattataatgagcatattacatctttatttgaagaataggaaaactgtgttctaaacacggtatttttatgcctatttttactatatttaaaaaaatatcaagtttagattatatatgtctacctaagtacacttaataagtttagaacaatttattgaattatcaaagtttaatataacttacaatgtatctataaatccagaaatattaactcctacaaatagattaaaaaaatttatagatttggttaaagataaaaatataaattgtataatggttccttagtgtaattcgttataagaaaaagggatattgttaaaaaatttcattaaaaacaataaataaaagtaagtttttatataatttttttcttactttcattttgtagtttataaaagttcacctttataaactttatttaatttatttatttttcgtttttaaatgtatataaatttctttttaaacgtttattaaaatctattgattttaataaacgttttttctatacttaaagtaataatttaaatatggagtgataaaaatgcgttataagttgacttatgtatatggtgactcagatcaaaaatttactcaaacctttagcagtaaagttcttatggaaagttatattgaaacaggtaaagataaagatttacgggtaattaatatagaaagtagtaaactatatggctatgcaagggtaagctctaaagagcaaaatttagatagacaaatagaagccttaaaggagtatggtgtaaatgaaagagacataataactgataagcaaagtggaaaagactttaatagagaaggatataaaacacttaaagagcagctattaagaagtggtgatgttttagttataaaagaactagatagactaggtagaaatatggcacaaattaaagaagaatggaatgatctgcaggcaaaagagataaatatagttgttattgatacacctatactaaatactgaaggtaaaagtaatttagaaaaaaccttaatatcaaatatagtatttgaattattaagctatatggctgaaaaagaaagagtaaagattaagcaaagacaagccgaaggtattgctaatgcgaaagctaaaggaaaacatttaggtaggccaagagtagaatatccaggtaattttaaagaagtatacgataaatggaaagctaaagaaatcactggtgtaaaggctatggaactaatgaatttaaagaaaaattctttttacaatctaataaaaaaatatgaaaaagaaaaaaaatctatttgaattttcaaatagatttttttatttaatataaaaacattttgtaactttttttgtaaatgataacgagtatcatatggtatatttatattgaatttgtattttatgggaggtatttattttgaatagtaaaaaaattatttgtagtttaagtttaggtatgtttatgagtcaagctctattaacccctggtgtattagtatctgcaaaagaattagttaatcaaccttcagttataagtgaagaaagtgaaaataatttagattacgaggccagagaacattttttaaattcttctataaatgtggaagaattaaaaggcaatgataaacaaatatatgatgaagtaataaaaaaggctatagatgaatataaaaatacgcctggatttgatgaacaagaatttattgaacaagtaaactatgttctttctaaagatccaaactcaacatcaactagaagaaagagatctattgtatctattcctaatagtgtagtggctacagctactaacgtagctataagtttagccataggtggggcaagtggagctgctattagagcatatgtagtaaaagttggtgctaaacgtgcaagtaatgcaattgctaaatcaataacaagtagattatgggctatgggtataaaaaatgtaactggaattagtacattaacaaacaatataataaaaaatatattagatcctggttctgctgtagcgtcctggttagatagtagagatagttctcctaataacggtagagtagaaataggttaaaaaaatagactaagtggtctaaatcacttagtctattttttattaagtttatcttttcttacagaatataaaatccaattaatattacttataataactaatattataagtaaaggaatccatagaaactgaggaatcattatcaatataataaatcctataacccaaattattattgaatatatcaaatatctaagaaataatttcaaattaatcacctgcttataataatagatttagaataaaaatgtaaatctattaatcatttaatggatttaaactttttatagtataatctccttttgattaattttacactatcttagaaaacaattacaagtattacattttatataatattatgttaaaattatactgttaatctgtatttttaaatatatttttcgataaaatttaaataaaaaagttaaagcaaaaagctttaacttttttattgctgagttataatgtgagtaaaaatattgagaggtgtatttatatgaatttagttaaaacaagagatgatttagaaagagaagctcctagactaaaaaaagagtggatacaaaaaattgatagtatagataatgcaaatagaaaatatgtattagtttttgaggatctagtattcgaggcagaccatgaacaggatattacttcaagactaataagagattatatagaaactgatgatagaaatatgcagcttctatttagaattgactttgcaagagctttaagtatgtatagcataatgaatggaattaatgttgaagtttataataacggtaagaaagtaagagataactatgctgtatctgaagatgatccggattatgaaaaggactatgaaattcctgatgtaatcctggatgtatttgatgaatttactctttttaagggccttaatgaacttaagtatgctaaaatatactataagtctgatgatggagagtacaagctattttaatataaattaaaataaagaagtagctttaagtaataaaaagctgcttcttttttataaggtgaacatatgaaaaaaagagaacaaatatatacatttttaatagattttataaaagaaaaaggatatcaacctacggttagagaaattgctcatgcagtaaatttaaagtcatcgtcttctgtttatagacatttagaaatgttagaaaaagatgggctcataatacttggaaaaagtgagcagagaggtagaaaaagaagtattcatattattgatttaaacaaaaagattaaaaaaaatgtatcaaaagaaactattaaaaatttaattaaattttcaaaaaaacaagttaatactaataatgatatattttccaagaaagttactaatgattatatagtagctgtagataatatatttcctgatgacattattatcgttgagaaagtaaattctctagaaaaggatagtataggattattattatttgaaaatcgtacctttataaaaaaaatattttcagattatgaaaaggtatatgatactgatcctatagttttagggaagattattggtgtttatagagattttttctgatattacttgaaaaaacataaaagaaacgttaaaataggttaacaatattaaaatttactgtaataatgtattagaaactttcgagtttatcagtcactagttaaaccagtattaactattaaattaattgcaaacttaatttaacctgtatatctattaacacaaaaaagattatctctttaattttagagataatcttttttgtgtttagaattaaccaagaatattatacaatttaattatatcctatactcatagtaattataaattggggtgagaaaatttatgagattatcagaagaagataagaaatgtataaaaattctttatagaaatggcttaaatgtaaaagaaattgaaaaattattaaataatgacttttctaaagatgctattaaaaaacatatatatagacatttaaatgaatttaggaatgaacatattataaatagatccttaaataaaaataaattaaagaaagaatttaaaaatattattaagaataatttttaataaagggttttccataattttcaagaatattatttatatattcttaaattagggggagttaagaaatgaaaacagctcaagaagtagccaatgaattagatttaaccaggactgaagtttataatttgcttagaaaaaaaagattttctccattagttaaaaagaacggtggtcaagtagcaataagcaatgaacttttcaaattattagaagaagaaattaaaaataaaagaaataatattaaacaacaagagaataaaaatatagatataaaacaagaagataaatcattagaagaaaaaaatactatagttgatgtaaaaactgaagaaaatactgattttacatcaactatagaaattctacaaaatcaaataaaattaaaagataatcaaataactattttaaataatgttataactaataacttaaaaaggataaaagatcttgaagaaaaaaatcatgaatttaaagagctacatgaagaagttaataatttaagacttgttattgattcaatacaaactaaaaaaaagagaaaaagacttttaggagtattttaaaaaaaatataactggaaattttatttccagttataaaaattacatatagtattaaatttaatcttctaaatcacttatatcaggtaaaaccaaagtttcttctttttccttgtattttatagagttagttttctgcgaagataaaattttatcacttatatcagaagatgttaagttattcaaatatatttcttccttttttttctccaacttagctaaatcttttaaaaaagcacttgcactacttttctcttgtatataatcgtaaagatctgcttccttttccttaaatgttattcttatttcccttggttttgccattttgcaagacctacctttctgaaacctttagcatttgcctttatgtctgttattgcttctgcttgaatatatactttcttaaatacaggtaatattctaccatcagctccaccacaaagacatattgcatattgagatatattaggatataatccccttaattcatttattaaaaacttaaccaacttatttaatgcttctgttttataagtattttctacttcaaacttttcattccttatatctaattctccatcaaaatattttctagcatcttctaaacttacacttaatttatatttcaagtctaaaacttcttgaacatttttatataaatctaataatccaacttttatactttttccaccaataaatcttccattttcatcaaataaagcagcgtcgctagttcctccaccaatatcaaccattaatagtttcactttttcttttttagcttgtagtgcttctactttagcaccatatccttctggagctataaatatatcttctatattaattgttcttgattctccatttatttttatatttttacattgattatttaaaataactttctttagtctttctttctctgagttatattgccctgctggaacacctataactatcttgacatcattttctttactattttccttatctaaagttttagcaatagtataatataataaatttataaaattttctttttcatgttttactacattattttcaaaatatccctcattgaaaataaattttttatcatttatttcaacaatatcattcccactaaaatcatccaattcttcaaactctcttaatctactttcagttataaagtcttctttgtcacctacaccaatacttgtaatattaccaatatctaatcctaaaatcatttttatcaatcctttctattatgtaaaattgtgatgttttttacttgcaaaatctaaattacgtaaaattgtgatgtttatgtttttatattatcatttttttcaatctaaatcaagcattttccgtaaaattgtgatgtttttttcattttcaacaaactgtcattacgtaaaattgtgatgtttttaattgaggctaaaataaaagagagtaaaattttctataattttactctcttgaaaaattatttttaacatggtattattaactcaattaaattaaatagtacggaaaaggaaaaatccattaagttttctagaacgccaatcaaagtaaacttaatggatgaacttaaatccgaaatagaacaaagttctatttgaaatattcacttttcatagctttatgatatcaaagctattgaaaaaagtcaatgatatctattgactttttaatagaaatgtaatattagcaaattttaacttctttctatttaggatttagtgtaatttcctagatgaaaggagttatttttatggcacacatacacttattaactaaagaacagttagaacaagagaaaaggtttaatctcgaagaaagagattttcatgtcttaaatcaaatcgaatataaagagtctagaagaaaagctcaaagtatcttaagatttatcagaaaaggtattttattaaataatggatcttggagcatctcattttctaaaattcataaagattataatgattgggtaaataaaaagaaaaagaaaagaccagaactaaaaaatataagcttaaaacaaataaaaaatatagtaaataaattaaaagatttaggtttacttattattgaaaatgtaaagaaaagaaactgttattttctgccattacccaataaattacccaataatgaaaacattacaatccctgatacaacaagcatagaaggtaatcaagctactcctaggtatattaggaataataatatagatatagattctaatagtaactcaaaagaatttaatgcagacatgtatgaaaaatgtacaagtcttgttgatgttagaaataaagttaaagagttacttaaagctgcaagagttaagagctcttggattaagaataaggttttaacaaaattaagtgaaaactatagaaatataactgttaaatttttagagagttatattaatacagtcattgagaacactagaaatacatattattcaaattatagaaaatatatcaagaacaatgcgaacaacagagctctaccaaactttacagaaagaaattattcaaaggattactggaaatacctagaagaaaatctatgttttaattaacaatttaacaattaatagaatttattgttaaaaaatagcttataaataaactgaaaaatttccagtttattaaaaattggaaattgccatatttttttatagataatttgatacaatgagaacagaagttcgtatgtatatgagaacaatcgtttgttttggttattgtcaacaaaataaaatgtttttatatagagcaatgatatttattgctctatataaaatataaatccttgagtatataacttaatattaaattttatgatttaaatagtatttaatttttcttccagatcttcaatatcgatattttctaagtcaagaatatcatttaaagatcctaaaactactccgattatattaatatcactatttttgtcataatattgtatttcatacggaagtgtactacatgggtgtagttctaatttatcttttttcttatgtatttttttacaagtagcttcattattttcacttaaataagctattactatatcgccatcaataggagttttatttctgcagcaaataattaattcattgtctttgaataatttattcatactgtttccttttactcttaaggcgaaacaatccttgtaattgctaggtaaagcaattgatttactaatttcattaaatgcatatgatggggttccacaagaaacttcaccaactacatctattggaatgaaatttaaattacttattaagtctttaagattacttgaaagaaaatcttctttttcagtagttgaaaaattataatttatatcttgatactcaagagcatcagataaatcagtttcatgttctttatctaaagtattagtaaattctttagataattcctgaaatagtttaatatcattttcagctctattacgagttctttttagctcattaaacattctttctgtacgttttttagacatttgaagctcattaaacattctttccgtacgtaattttgaagtttctaaatcgttaaagctttgagtatttttttctataagcttatttagtataaatattttttttgaaagatctgaattgtttaaatcatttgtggtttcatttggatgatttaatcctaatagagagtcaatagaacgattcattaacttagataattgtactaatgtatatatgtttggttctacttcagctctttcataataaccaatagtagttcttgctacacctagtttttcagcaagttcagcttgagaaagtttattttttttacgaaattcttttatgtttaaagctaagttgtgtagttcaatttcaatcatttataaacctcctttcaatatagttttagcaattttagaaggaacaatctaatgaattctttaaaagagtgtcaatactatcgttttttaaaagtgtaaattaaatatgatgtgtatattgacattgatgagtgagcgtgataatatataggtaaattaaatgaaaatatggataaaggtgataaatatggaaaacaagttaagctttctaagaaagaataaagtgctttctcaacgagaagttgctagcttaattggtaaagaagcacgttttattcacagattagaaaatgggaaagtaaaaaatcctactgcaagtgaagtctataaattatctagaatatacgatacaagtatggaagaaatttatagagcaatagtattaaacaactaaataaatttaagttttgtccccactttaaaaaggagtcgaactatgcccttttttaatactcttttaggacatttttagggagttggtgatttgagaggaaagaatgagcttgataaaagtaaagttaaaagtctttacttagatggattttcagctaatgaaatagcaattagaatggattcaaatcgagaagccgtaaagaaatgtattcaaagaaatttttctgatttaagggaacacaacaaagctaaaagggaattgaaaaaactacaaaatgaagaaataaggaaaattactcatagagaatgtaaaaagtttatgagtgatagaaactttgttaagactaatagttctatttacaaacataatggacatggaaattttagtgttaaaaaagaagaagaaattggatgtgtagttcctttcgatgttcccaaacattttagttttaagaaaaagttttagacaacttggtacatatgcgagatatatttaaaaaatattatttcaagggagagaattaaaatgaataagagaattaaggccataatagaatttgtgaaagtacataaaaaagaaactataggagttgcagttgctttaggaatagcagtcgttggtgtaggtggatatgcaataagtaagcattatgctactgatactaacaatatagctttagctgagaaaaaagaagatcctaaggcagatgaagataaaaagctagaagaaaataaagctacagacaatgaagaagtaactgtagaagagcaagaagatggatcattaattgttaaagataaagatggtaatatcatcgcagacagttctaaaggagacgatgtttctaagatagttgaagaaaagaaagaagctggaagtgatgttaatataaaaaataaaaaaggtgaagttgaaaaagtagagagtgttgataatggaagtataaaagtaaccagtggtgaaactataggttctaaaacagaaaataaagttcaagcttcacaacaaccaagtggtgagaaggttgagaaagtggaggatataaaaggcactactgcaagtagtgaaggaagtattacaattgtaaaacctagtaaggaagaaagctctagtaagcctgaaagtaacaaacaagagcaacctgaagagtcaaagcctgaagaagctccacagccttctcaaaaaccagaagagaataaacaagaaaaacctgcagaaaatcaacaagaaacaaaaccagttgaacctgcaaaacctcaaaagcctcaaagaacttgggaatatcaaagtggtatgagccaagagctttggaatgattttaatgcttatagacagtctcaagggttaaatgctttaaactggagtggtaaatatgctggatggacaaagagtcactgtgaagaaatggcacaaaagcaaagtggcttccataagagttatccggaaggtggtcaaatagtttatgatggaactgcatatacttcagctagttctattttaaatggatttaaaaattctccagctcataataagaatatgttagatccggatttaacagaaggagcttgtgcagtatataaagacagtaatggaagatattatacagttataggttttgactattaatttatatataaagatctagagttttactctaggtcttttttgatactgttttttagggggagaacatatgggaagagtgaggaaagatttttataaaggagaagtctataggggtgatattttctatgcagacttaggagacataaagagtaagtttggttcagtacaaggtggaattaggccagttattgtaattcaaaatgatattgggaataggtatggagaaacttttgtagtgacttctgtaacatctcaacctaagaaagaaatgcccgtacatactaaaataataaaagaatgtttagaaaagccatctactattttattagagcaaataacaactatttctagatatcaaatgagagagaaaataggaaagctaaatggatatgaaataaaagaactaaatagagcattaggaataagtattggtttaagttagaaagttcaagagtgttgcaattaagcagcactctttttaaatacaaatttttagaaaggagaaaagaaaatgaagtattttgatacatcttaaattaatttatcaaaataaaaaataaataatatggaggagaaagaaagtgagtaaaagaaaaaggtttaaactaattacaacaataactttaatttttacattcttattaactaatattaaagtatttgctgtagaaataaattctacagatgcagagagttatctaaattacaactctccaacttggggaaaggttcttcctataggtaatcatagatactatgctccagatctaaggacctgttattgtctaaatacaggtgcactgaatccaactggacaagattacacagaagaaataccagttgatggaggaatagaaactattatttattgggggtaccctgctaaagatggctcagaatgggggatatcagctgatgaatatagatattgtactcaacttgctatttgggcttatcaaaaagaagctggtttaagtaggggaattgatagaacaagacttcaaaatggaacagtatctttaagtagattaaaaccagtaatagactttttagtagaaaaaggattaaacaaagagttaccaacattctttgaagttactcctagtaatatagttgctcatcaagaaggtgattatttcgtttctgagcctataaaaataaaatctgactatgagtttaaagatgctaaggttactataaaaagttcaagtaatccaggattaaaagatatagttaagataaaagatatggatggagatgaaagaaatacctataattctaacgaaagttttagagtttatattcctatagacgcagaaacaggagatattaaggttgatgttaaagcaactgtagaattaccagcttctttagcttatgcaactccagtagcaggtaaacaagacatggcacttgttgatttaagataccaaaatatgaataaggataatgttactgtatcctggactggtttaaatggagctatagaacttgttaaaaaaggagacgatggatctcttttaactggtgctaaatttgttttgaaaaacaaagaaggcaatcaaatagctgaagctacatcagaaaatggtagagtagtattcaatgacattaagccaggagaatacatcatcgaagaagtcgaagctcctttaggatatttaattactaatccagttaatattactgtaaaacctaataaagtaactactgctgaaatggttgatactcaaataaaaggaagagtagaaataacaaaaattgatgaagaaactggcgaaccaatttcaggtgctgaatttgagatggtgaaggctgataataacgaagtagttgagaaaatgactacaggagaaaatggaaaggtattaagtgggttacatccttttggaaactacattgtaagagaaacaaaagccccaagtaaatatgtgcttaatggtaaagaatatccagttactattaatgaacatatgaaaacaatagaaattactcatgctaatagaaaaattaagggtagagtttcaatacacaaaatcgatgaagaaatgccagaacttagtttaaaaggtgctgtacttggtatttatgatgatgcaggtaatgaagttgatagattaacaactgacgaaaagggagctgcaacaagtaagtatctagattatggtcactatattggtaaagagctacaagctccagaaggatataaattaagcgataaaactatagacataaacataactgaagatgataaagtttattcttatgactttactaacaaagttatgaaaggtcgcattcaaatagttaaagttgatagtgaaaacgaagaaaaaccagttgctaacgcaggttttaaagttgttgcagttaatgttaatggtatagaaccaggaactactgtagataaagttaaaactgatgaaaatggatttgcatttactaaggatcttagatatggagtgtacaaattcattgaagatgaaactccagaaggatattgggctagtgataaggaatacacaattaacataaatgaagataataaagtttatgttaaatacgttaaaaacgctcctatccaagctaagttaagagttgttaaagttgactctaaagacaataaaccactagaaggagttaaattccaagttagaaatactgatactaataagcttgtagagtttacaaactttgtaggaataattcctaataaaacaactactttaacaactgataagaatggagaaataataactccacaacacttagcatacggaaattatcaattggaggaggcaaaacctaaggatggttatataagcataaagccaataccttttaaaatagacgaaaatgccgctctagaagatattaaggacttaggtactgtttatactattaaggtatctaacgaccgtataacaggcgatatggagcttttaaagatagattcagaaacaaagaaacctttagctgatattgaatttaaagttacagctttagatggcctaatgaaaggacaaacttgggacttaaagagtaatgacaaaggaatagttagtttaaaaggtttagaatatggtcattacaaaatagaagaagttaaaacactttggaattacgttattaacaaagagcctattttctttgatgttaaagaaaatggtcaagtaattaaacttgaaatggaaaataaaaagataagagctaatgcagaattaatcaaggtagattcagaaactaaaagaccacttgaaggggctgagtttgaactttggaatggtgaaaatcttgtaggaaattacacaactaacaaagatggaaaaatagtagttgaaaacttagaagcaggtaactattatttcaacgaaattaaagctccagatcattacgaaataaatcaagatcaagatttaagttttgtaatagataaagacggtgaaactaagactgtaactgcagaaaataaagtaaaaactggagaagtagactttactaaaactgatgttacaaatggtcaaaatattgaaggtgctaaaatagagatagtaggaatagaagaacaaaacaaacatgttaaatttgaatttacttcaagtttagctggcaataaattcactttaccagaaggtaaatatgagtttagagaaactcaacaaccggaaggatacgagctttctactgaagttggaacttttgaaattaaaggtggagaaattataaaggccaacttaaagaatgaaagaactacaggaaaacttatctttactaagacagatgttgctacaggagaagttcttgaaggagctaaaataaaaattgaatgtctttctggcttagataaaggaaaggttattgagtttatttcttcaaagaatggaaatgagtttgaattagcagctggagaatacaaaatctcagaaactcaagctccagaaggatatgagcttacaactgaaactggaacctttaaaataggtgaacatggggaagtagttaagtgtaacctaactaataagaaatttgaaattgttaaaacaggttcaagcttcgatgttaatgcattaattccatttggaattatcttagtaacaggaggcttaggagcattaatactttcaaagaaaagaaaattatcataatttttttaattaagagagtgccataaggtactctcttaagtttacataagaaaataaggagatgggatgtatggttataactattattttaggattgattattataaatacttttatgtatatgagtttatttaaagtggctaaaaaagctgatgaagaacttgaaatattatttaaaaaacataattttcaacaataaaagggagtgagaaaaatgagtgaaaccttattatgtgaaatagaaaaattagatttagaatttagttctttatcaaatagaaaattaaataaaaaggacctagaatacagaaaatatttaatttcaaaactacaaagattatcgaaagagtatctaagatcttgtgggataagaaataaatataaacttgaaaagatcctaagaaagtattactttgaatatcatataaaaacatattttaagttttttaactttaataatatagcagtttaggtgtcaattatgatgaagaaaggatttataacattaatcataattggaatattgttaataggagcagctttatttattgagtttaaatcaaagtcaatccaggatgatttagttcaaaaatacgaagaaaaaatgtatagtaattcttcagtaaattatagtattcctgaaacaactgaaaatatagagaaaaaagaagtaataaaagatacttttactaaacctaataacaataagaaaaatgaaaaaaatgatgtaattgggatattagaaatagatagtataggggttaaagctcctatagttttaggagaagaaaatctggattatgtagtggctaagtacaggtcaagttctgattttggagaattaggaaatgtaatattagctgcacataataatatgcgtggatctatatttagaaaccttcataagcttaaaataggagctacagtaaaaataatatctgataataaggaacttgaatataaaataacaaaccgatatatcgtagaacctaatgacacaagcaaaataaatttttctaatgacaagaaagaaataactttaataacttgtattaatcatgctaaacaaagattaattttaactggagaattagttaattttaacttggtacttaaaataaaataggaggaaataaatgtgtatgaataagaatactagaaagataggcgaagttagaaagaaagttgaagctataagagaagaactagaaaaggatgttctttttactgctaaaacacaggagtcaaaggagagaattaatgtaataataactcaagatgccaatgataaaataatggactttatgtatgataatgcaaaggttcttaaagaacaatatggcatacaatctagaaataaattattagctgcaattatagaatttgaagcagatcatatagaaaatatatttgaaaagttaaaaagaaaggagagataagatatgggatttagtttaagaaagtcttttaaagttggtaaaaattctaaagttaatttatcaactggagggggtgtgggatttagtacaggtaaaaaaggagcgagagtttctgtaaataaaaatggagtaaacttatatggtggtaaaggtattctacgatttactaaacatattagttttaagaaaatatttagttttttaaacaatctaaacaaataaaataatcatataaaacgagttgttctccaagaacttaaataatgttcaagggggaatttttttatgcaaaaatcaatgttaaaaccgccgattacaaggctaggtggaaagagtaaatcaagaaaagaaataataagtatgatgccagatcatgtatgctatgtagaaccattctttggagctggatgggtgtattttggcaagtcaaaatcaaagattgaagtaatcaatgatattgaaaatgaaataccaaacctatttaaaattataaaataccatgctccggaaatgaaaagacttctgtcttatgagatatctggaaggagtatattcgatgaatataaaaatgctactttggagcatttaaccgatatacaaagagctataagatttatgtaccttataactcaaagtttcggcggtcaaggtaatcattatggttatggaactaatacattgccatcacaaaaaatctttgattgtaacttagatgagctacaagaaagattaaaaaacacttatatagaaaacttagattttaaaaaaataattgaaaaatatgatagggaatatacattatttttcttagatccgccgtactatggtacagccggatatgaagcagagtttggaataaaagagcaattaaaacttagagatattcttaaaaatatcaaaggaaagttcattctaacaattaatgattgtgaagaaactcgaagttggtataaggactttaatatcaaagaagttgaagtacattattcagtttcaaggcaaactgaaggaagaaaaagaaacaaagagttgataattacaaactactaaaaagtagatggaaggagattaaaattatggctgcaaagttagataaaaattcaaaagaattagtacaagatttattaaaattacaaggagtagaatatatagattggttaaataaaaagcaccaagaagtaataactaagaatacaaagattataagaaattgtgttaaaaatgaaataaaaaactcaaataaaaaagatgaagttatagaagaaattaatcaagaaagtaatgaaaatcttgaaagttttgaagatgaaaattacaatgaggatgaagtagaaagtgaacggaaggagttaatttattaggtgaaagatttaaatttatatgcaaaagaattagttgatgtagttaactatttaatgaaaaaaaatcaattagtttttagtagaaacaataagtttatttatgtaaatacagaaacaataaagagtatgttagagaaaagaaattatgatactgttgatgggaaattgtatctttggagagagttagaatggattgagtgtgcagaagataggttcaataaacgtataaaaatagatggagaaaatatgtatgcagtagttataaaatatagctcatatagtattttaaaaaggctctatttagagtaaaatatgaactttaaaatgttaattttatagggaactttagggggaactttacaaggaactttacagggaactttaaaaatttaaattgatataaaagttccctgtattagtataagtattttaaaggtatatatcattattagttccttatcgtattatagagtatatattatatatataatatatacatataatgtattggtcacaaattgtgttttaatttgggactaatatttatatatatatatgttattatagataattatatactcttgggctggagcgtttagctccagtccaaggggggaatggggggaagtattccccccataggaaggagtgtaaatccttccgtataaactctcaatgaaaggcaagtgactttaattaaatgaatatatttaatttaaaaaaagaaatgaaaaatattatttattctgattcttctttgagtaaaaattctattagagatagaaactctgctcttaataaaatatttgaaaattttaataaccttgatgatgtttctgttattactaaagataaaattttagataacttaaattcaattaaatttaaaactaaattatctgcaggtgttaatgctattagatttttaaaagggcaaaatcttgatgttgattttccttctgaagatgaactaaaagagattattaaaaataaaaaaaagaataatcgtaaacctactgtagaaaaaaatttaattgatattgaaagaaaagttaacagagttagaaagaaaaattatagactagcttataagttaatgttagagtcgggacttcgtgttcacgaggtatcagctctaaagaaagaggacttttcttttgataaaaacttaataactattaatcttagagaagctaagggtaataaactttgttctattgaacttgaaaataaatatttatctaaaaacattagtgagtttgttgaaactaaaagtgaagatgaaagagtatttccacacatgagatacttacaagaacaagctactaaaatgggaataaagtgtcatgatctgagaaggggatttgctaaaagaacatacaaagaagaactagaaaatgattctccaagaagtgaggctttagataaaactagaataaagttacgtcatactagaagcgacactactaagatttatttgaatagtaagattaaagtttaaataagagtgctttttataagtgctcttatttttattattttttttagaaaggagtgatttttttgagtagtgattgggagaaaaaagttaatcaggaaatagagaatggagcaaatgcaattataaatgagattgcaaatgttctaagaattttcttttttagagttggattaggctttaaaaaatcatggaagaataaaaagctttttattggtttctttttaagttttttaattcctatagctgcaagaattaaaagtgattactttcttgtagacactaaattttattttaaaataatatattttttaacctttatagctcctttattttatatggttatagtatcttttgttaagaataaggaagataaaaggaatgcagaatatagacttgcttttgaacaattaaactttgttggtgcagattctaaaacaccaattttaaagtctttcattgaagataagggtactagaattgatgaaataacctttgagtcaatgatacctattgaaacttggaaaagttatattccacaacttcaaacatcattaaatatttctataatttcaatagagcaaggagctagtaaaagaattgtaattataaaatctatggctggagatgctaagatacctaagtaccttccttgggatgataagtatatagaagagcaagaaggggtagttgttgttggacaaacttttagtggaaatataaaaattgatttaaataaaagccctcacattttatcagcaggggaaactggatcaggtaaatctgtaattttaagatgcatactttggcaactattaaaacagggtgcaatagcctatatggtcgattttaagggaggcgttgaattcggtttagagtatgaaaaagtagggcaagtaataaccgaagttgatgctgcagaaaagttatttaagtatttagtagatgaaaatgcaaagagattaaagcttttaagagaaagtggttctaagaatataggggagtacaataaaaagtttgaaggagaagaacttaaaagaattattgttgttatagatgaattagcagagttaatggataagacgggtgttgatgatgaaactagagctaagttagtaagaatagaaggctatacatctacattggctcgtttatctagagcaactggaattaatctatgtattggagttcaaagaccagatgcaaaggtaattacaggacaaattaaaaataatgtaccagtaagaatttgtggtagatttgcagactctaaagcttctgaaattgttttaagtaatactaaggcaaaagacttaccagaagttaagggaagatttttatttaagctaggagctgatacagtacagtttcaagcattttattttgatgatgataaacattttatacctaataaaattttaaaactaagaaaagatgaaattgaagataagaaagttggtctagatttaaataaagaaaagttaattgataatgatttaatgaatagtgtaaacgaaaaatttgaaattaaagaagttaaatctatggattcaaatattgaaaatgaagatgatagtaaatttgaaaattttgaagaacaaaataaaactgaaaatctaaaatcaactataaatgatgattatgaataataggaggtagcaatatgttttttaaaagaaataagagtaatataacttatgctaaaaaagaaggagataaagctttaggggtattaattaatgctcctaaaattttaccttggagcaataattatttagatgaaaaaaatggagttataaacttaggaacaggattaaatgattctgttattaagttagatttaaataaagctcaaaatgtattaatcgttggtgaaatgggagtaggtaaaactttacttacaaaaaatattatttggcaacttgtaaatcaagagtcagatgtttatatgattgagttatcaggtcacgatgagtttgattcaaggtacagtatgatgggacaagtaataaatgatcttaatagtttagaaaatttattaaaagagctactagatgaacaggaaagaagaactttgattttagaagaagatgaatttaaaagttttggagctttcaatgaaaataggtttgattctaagaagttaaaaagaaaagttgttgttattgataattattataatcttttagagaaagctaatattagctcaatagagcaaatacaggtagagataatagagaagagtttaattaaattaataagttcaactaaagatacaggtattaatttaataattactgacaatgagataagcaaattaaatattgagttaataaataaaattcaagttaaaatttgtggtagacataatgagcgtaactctaaattaatgctaggcgatgatagagctagaaagttagattgtatagcaagtttttttatgaaaataaataatgaaattgaattttttgaagcttatcgttttaatgaagaaaagcagttaaagattttagagtcaattaaagtagaaggcaaagaaccaatttttaaaattgactttgaaactgatataaatactatccttccaggaactttgggagatggtaaaaactttgtattaaaagataggagtgaggattgtgtttagaaagaataaagaaaatactaagcctaaaaaagagaagaaagaaaaaaagtctttctttaagaaaaaagataaacttaacatggatcttgaggattcagttgctaatttagataagcaggttaatggtgttaaggagaaaaaattagtaagtgtaatgccttttagaatagcaagagcttttatatgggttcttataggtattctttgttttagggggggagtttcagtctttaaaggtaatcaatctgaagctttgaagaaagaaaatgaaaagatattaaataatatggagaagcaaagttcacttgaaactcaagctttttcttttgcagaagaatttgcttgggattatttttcgagatatccaagtgatactcaagattttgtaagaagaataacgaagtatactacagagcaactagcaaatgagatgaataatggaacttattcagatgtcatttatactagtgctttttattttgaaaaatattctgaaaatcaagttaacgtaagtgttaaagctagagtaagagtttatacacctaaagctggccaagagcaaactccacaggaccaacttcagtatgatactaatttagttgattactatttagaagttcctatagttttcgataaagatatgaatatggccgtggatgcattaccagtaatgacagctccaccagagaaagcttatttcaaaaataaagagttctccggaactagcgaaaatgatgctgataaaactaaaaagattacagatagtgtatctcaattctttaaggcatattacgagcaaaatcaaacacaaatagattatttcttagttgatggagcagatattaagggagcaggtcaaaagttctctttcaataaaatcgatagaataaatatttataagcttagtgataaagaattcttggcaattgtagacttaaatgtagattcttttggaaatgcaataaaacaaggatttaaccttactgtagttcaagaaggagacaagttcttagttaaaactttagagccaagaacttcaaacatagatttaaataataagagcaataattaggaggatttattatgaaaaattttaagaatttaaaagagaaagtagcagagaaagtaaaattaaacaagttgagaatacaaggtttttttgtagcattattatcatttatgacaacttatagcacttatgcttatgcagatataaatggtgagagtataaagagtaatcttataaataatattttattacctatatctttcgtagtagttggattcttattaataaaagagcttgctaaaaagagtgttgcaggtatattagttgttctaattgtaggtggattcgtaattataatgatagctcaaccagacttgatgaagtcctttggtaactttgtaaaaaccatattaggtttataggagtgatttttatggaggaagatagaaagattttaagaagctataataagcttaaaaactttgaaattaaaatttatagattaggaaatactacaataccatttccagttcctataacaactacagtttattttgttgtggcattaataataattgctattatagatgctacaattgggatacacataaattttatatataagtacgttgctttacctttaggtatagcctatatagccaaaaataaaaaaatagatggaaagccactgcataagtatttactaagacttatacagtttcaaaatatcaagaagtctaaaatagaaagatttgagattcgagagaatttagaaagttttagatttatagaaagattttagagagttagtttaaactaactctctttattttattccaagttggaaaggagtattcttatgaagaaaaataataaatttgattttcctataaactttgttaaggaaaatttgatttttaataataaagcctgctatgcaggatttaaacttaatggatttgaatatagttcttgtaataatagtgaaaaaattaggatattagatagtttaaccgaacttataaaagaaatacctagtgaagctcagattttattaattccaagagcagtggattgtgagagatccataagacctatgataaataaaatccaggaagatgatcctttgaaagaagtttcaacaattttagcagagaaaactatagaaattttagaagaaagagctgaggatagatatatatttaatcctgttactgaagaaaatgaattcattgctggagataaaacattagaatatgacacatatatatttatttcccttctaaaaggcgacgacaaggattttatttctaaaggaggggaaatattcgagtatatgataaaaaaccctaaaaaggctttaaatgagtttttaggcatatctcagaaaaccatatctgaaagagattttagaatttataagaaaaagtctacagaatttttagaaatacaatctatgagatttgatatacgtcctttaagaaaaagtgaaatagatagtttgagtgccagggttactaaacgtggtcatcaatcagcggatgagcttgttaagtggagtgataatttcttagaagtagagcaagatgaagaaaaagttattattcctttaagaaatgcctataaaaatagagttactggccttatagagcaaggtgataaaatattaaaaatacaaaatgatggatttacaagttatcagactttcttggccataaacaatattccaagcatggagtttccaggcgttgagtatataaagttaatccaggatatgaatattggtgcagagatatgcattcacataaagaagttttctgcggaagaaagcaaaagtaagataaaaaataaagctgctaagataaatgcacaggtaaatgaagcacttcaagggggacatataccatctgatgaagaatacgaagcgaaggcggccgcagagtcgttagaaaaggaagtaaagagaaataaacatataatcgaaacaagtataagtatttgtttagcttccacaaaggagaaaatagttagaaataacaccaaagtccttatggaatatttcaataaatcactaaaatttgagcttataaatccatatacagaccaatacagaattttcttagattttataccagctaactctaattataatagagacttcatacagctagttccaatggaaacattagcgggtggagtatttggagctagtgaccatttaggagatagcgtaggagcctatataggctacacagtaaatggcaatagaaaggtttatttatacatgggaagagctacaaagttaaataaatcacctgctatgggcatatacggtaacttaggtggtggaaaatcttttaatgctaatctaattgtagttttacatgttcttttcggtagctcagcactaattttcgaccctaaaagtgaaaggtcacattgggctgctaaactagatttcatgggagatttaataagtatagttagattaacacctaacgatgaagataagggtaaactagatccatttaatctttataacgataatatagacgaagcttgtgacttagcttttaatataatagttgagattgctaatacaaatgaagaagaaaagataattttaaaagaaactttaaataaaatgaaggatgaaaaaagaccttcaatgaagcgattaattgaaatgattaacgatgtatcagatagtgatgcttataaaaaagaagcagagcgtttggtaagaaaactaaatgcatcaaaggatgtaggtttatctaaacttatttttggagatggtactgaaaaagctattaatctagacaatagattaaatattcttcagatagataatctaacaattccagatcaaggtacaaagaaagaagaatactctgaagaagagaaattaagttcttgtttaatgatgcttatgggaagttttacgaagaaatttgctatgaaaaaaagaaataccttcgacttaatactctttgatgaaagttggtttttgaaaaattctgctgcaggtagaaaattatatgactttttagcaagacagggaagatccttaaatgttggatgtatatttaacgggcattcagttcttgacataccaactgaagaaattaaaaatactataacatataagttatgtttcaaaacaaataatagagatgaagcaaagagaatgcttgaatttatgaataaaagcattactgaagaaaatattaaaatgcttatggaattagaaaataggcaagctgttttccaggacttagatggaagggttggagtaatagaatttgacgctgtttttgaacagtttatagagtgttttagcacaacaccagaagataccttaaactatgaggatgtttcttaatgaaaaagctttttatatggagtggaataatatctttgatatttccacttctattttttttcttaattatagggggaagtggtgaacagccaactccagtaaatcctaatcctaatttaacggaagagcagcttaattttataagtcagattgtttccggagcgaagcaatcctatgaagaaacaggaatatttccatcaataaccctggcacaagctatattagaaagtggttggggaagatctgggttggccataaaagctaataatttatttggtataaaagctgactccggatggaaggggaaagtattagaaatgccaactcaggagcatgttaatgggggaataataactattatagcaaggtggagagtttacgaaagctggaatgaatctgtaatagatcatggtaaattctttgtagaaaattctagatataaagaaaatggggtcctggatgcaaaaaattatgtagagcaagctcagtgcatacaaaaagcgggttatgcaacagatccaaactatgcaaaccaattaatccaggtaataaatgattttggactaaatctttacgatatgaacggagatgttgtagggaatgatgttatagaaaaagcaatagaagctggaatgaagtgggttggtaaatctccatatgtttggggaggcggtcgtaaccaagctgacgttgatgcaggacgatttgattgtagttctctagtgcattattgttatgcatctgcaggaatacagttagggccaagagaaagtgtaacaacatggtccttaataaacatgggtaaacctgtacctgcaagtgaaatgaagcgtggagacttaatattcttcgatactgctggaaggaacggccatattggaatctaccttggaaatggaaaattcttgaatgacagttctacccaaggagtaagtattggagacctaaatagtgcttattggagcagatattttaacggaaatgtaagaagagtcgtagaataaaaattcggctttaagaagaaaagtacctggataattatcaatatttttaaaaatatccaggtacttttttataaatttacgaacattaatcggaggtgtgaaatggagaatgtgaagattaatatatatagtaaatttctgtatttgaaaaataaattaacttataaaaatatattaaaagcaatagttataattgcaactatcgttatagcttacaactgtttaactaaaatagcttatgcagatggatttttaagctatggtaatagtgatgatccttataaaaacattcctgagggatggggaatgtttatttctgaaaagtacagaaataactatgccttagatattatagatactcatggttgggagcttatagataaggctataacaggactaactaatatagtatttagcggaatagtaatgattagttggtttggagtaaatatatttagattttgcttcacaaatgatatagctgcaggctttgcaaatcaattaaatagtgtgttaggctctctaaataatggaattttcaacaatttctttatgatagtatttatgatttcattgttttcaatagtttataatctatataaaaagaattttagtgcaataggatcacaaatacttgcagtagccataatatatgcaactacagcttttttaagcaatggagcagttggcttcttatctaaaacaacggagttctctaagactataggaactagtgccatagttgctataaatggtaaagataataatgagggttccttagaagattattctaaaactgttgtaggaaccttatggggaaatttcgttcaacaaccttgggtaatgctagaattcgatggaaaggttcccttaaatgatgaaaatatgacaactaaaaattctataaatgaagaagcgttaaattactcgaaagatatactatcagagccttatggtagtgatgaaagagaaaaagctttagagtcaataaatgaaaaatttaataaggagttgttttcaaagaatggcataaatactaagttggtatccgtatgtgtattattcgtaataactctaataaaaatgattattttaatagctgtaggaatgatacaaataggatttcagcttatgtcaattcttttaatattgttacttccatttatcatgcttattgccatagtgcctttctttggtggtacaaatattataaaaggaatagcaagaaagtatttaggaactcagctcggtataattgttagtagctttgtattagccttactggttcttgtagatactgttacacttacaatgtttcaagcttggggagctaacttaataatagctcttttaatgcagtgtacttgttggatcatggttattgcctttagaaaacagttaatgaacgggttaataaaccttcaaaatagaattgctccaggaacagcaggagcatttaggtttggagctaaaccactagataaaggtgctgatattgcaaaggaatatgcagtaaatccagctatggatagagcgtatgacataggagataatttaataactaaagctcaatatgctaaagaatatacaaagggaaatttaagtctttacaaagacagaaaagtagcacaagctatagatttcttaggttctaaatacgataatttaaaaaataataagcctgaagatatagagaatgctaataatccaaaagaaaatatagacggggttaaagatacaaaaaataaagttaactcaaatgaaaatatcaataaaaaacctgtagaaaaatttgatttaaatggagttaaggccactaaacctagtaatataacttctgaaaatattcctaataagaatattaatggcgaaaataaacctaatattgatgaagacgcagttactaaaaatgatataaaagatcctatagaaaataaggatatagctcctaaaactatagatgaaaacattaaaaataatggaaatgataatggaactatccaggataaaagtccaggaagtaaagaaaataaaactatttctgaagatgaggaaataactacaaaaccagaagaaataaaaactcctgaaaagactataaataaagaaaatctaaatgaactaaaaaatgaaaatacatctgcagataagaaaaataatgatagtaatagtagtaatataagtgttactgaaattcctgaagatttagtggaggaaaaatctgttgaagctataaataaagccaaaaatgatgttaaagcaaataaagaaaaaataaataataatataaattctaagaatgttgaaagtaatcctgaagtaaaagaaaatatagaagtagcttcatcaccagaagttacagaaattaagaaaaaatctactaagaaagttgaaaatatcaaaaataatggacaaccaaaagaaaaatctgcagataagaaagaaattaaagaagtatcaactaaagaaagagttgagagagtaaaatcatttatgggagtaagtaataaggatataaaatctaaagaaaagcatttagaaaataaattagaatacattaagaaaggaaatagcaaaaactttaagaagaaggggagctgattatgctatataaaacacatttatcaacatcactaaatgttgcaataccagctttatatctaagcaatgagctatcacttttaacattaacgggagtaggcttggggagcctacttccagatctagatactccaaatagttttattggaagaagattaaagataatctcatatcccttaagtacaatatttaagcataggggatttcttcattcaataactcctgtaatattaatatttattttaggcatattcttaaaatcactatttataaaatctatcgctttaggttatttacttcacttagtaggggataccttctcagaaagcggcataaagtggtttttacctttttataataaagatattaaaatgccattaggtattctaagatatagaaccggtggcctaaaagaatatgttatactaggaataagcattgtaatattaatgctagaaatacaaaaatttcatttaataaacttattttcaatataggaggtaatatgaagaagaaattagtatttttaggtctaatatgtttaagtttatttgcttttgtaggttgcggaactgaaaaactagatataagtaactgcatagatgtacgctatggagaatttaatggttcagccaaaatatatgaaagtagtttagatttaggaaagttacaagatattcctaagttaaagggacttactcctgatatgctaaaaggagactataaaataactttagtaggagataaaactgatttaaaaaatggagataaagttaaacttcacctagagtataacaaagaactatataaaagagactttaatgtagaatttaaatttgaaccaactgaagtaactatagaaggtctgccagataagttaacagatataaatcaaatttctaaagagcaatgggataaaatatatgctgaagttaataaaaaagctgaaattaaagctaaagataataaatattctgacttaaaattagaaaaagttttagaatttaataaaaaaaaatcttccggtggaattacaatagagtttatttattcatataaaaataaactaatgaaactagatatataagtttttatcatttatttaaattcgataaagaaaatactttttctaatatagaatttttagaatcatctatttggaatgataaattttcaattaactatagcaatacattaaatgaaatattaaaacaggtatatcctgataataattataaagttttatggagtgcagaaaattaattttttaattgtagattataaaataacgatgataaaattatattatcatcgttatttttataaaaaattttggtaatatattgtctaattttaggaaatattgtataattaatttactcaaggaaaaagataaaaaatactataagaaattaataataagttatatactcgtttaaattacatatataaatttttcatagtttaaaaattttgatttttactatgtttatttgttatgtaatttaagcgagttctaaagtccaagctcaaggaatttgagtttgggcttttttatatgcttttttagagtatagactacaaatctatacagttgcctataacttaaataggagcatggtaaagccgttgtgataacgtaaatatttaccggagtgagcagatacactataaactaatcttagcgaaagctaacaagggtttgattgagccaaggaagaaagttgatccggctattctcatattacacatatatgagggtataacgtaagtcttattgaaactctgatgaagatgtttagtctaagtagctctataagagctatatgacaaaattcagcggttacgtggagtacctgcagcttaaaaataagctgcaacgaaaggaacgtatagagcagtagaaatactggacaggtaggggtacaattcctgttttgatgtacggattaggtgaaatactaatcactaatgtgttgttaccgggaccataggttaatgtggcgaggctctgcatagggatcttaattcggtgacatagttatcctgttctttttttaattaaatcggacaggataactatgtacattttgagggtactcgggatctaatcattaaaaacttaaaaagtcaatatataaattaaatgtaaatttgaatttatttagatattaatagattttataagaagtaaagtgatggtgaagtaagatgaataagagaaagtgtaccttatgtaagaattttgataaatataaagaattcaattgtttgtattttaagataaagatagaagatcctgaagtagcaacaaaatgtactaactttattccaaagagaaaggaaagtagaaagccttgtaaggattgtatatattacgtacgtaatccaaaggtaattcaagttaagaagaataaagttgtttttgataaaagattttattattgtctacgccttaataagcgagggacttattttagaaaggttaattgtaaatacttttcagaagaattataaaggaggaagagtttatgaaggtattaagtttatttagtggaataggagcttttgaaagagctattgagaataaaaatattgagcatgagatagttaattattgtgaaaaggataggtatgcaagttatgcctatagtaaactttttaggttatctgaagctaagaatttatgggatgttaattgggttgatggaacacattttaaagatatagatcttgtaacctatggcttcccatgcaccgatataagcctagctggaagctgtaagggaataattaaaggtgaaacaaaatccgggctgctatttgaagcactaaggattatagaagaagctagacctaaggttgccatagccgaaaatgttagaaatttagtaagtaaaatgtttatttctgattttcataatttaattaatgaattagataggttaggatataactcctactggaaaatactaagtggaattaactataattcggcccattctagagaaagagtattcatagtcagcatcaggaaagatatagacaacgggagctttgagtttaaagaaggaaataataatttagttaccctagaaagcattactgaaagctttgtagatgaaaaatattattgtaaagataattcttatttaaaaagcttcttaaataaggttaataaaagagtttgcaaggataaagagcctagtaaattcggattaatgagagttggaacaattaaaaatccacatatgttacaaatgaatagaagagttttctcagagctaggagctagcccaacccttgtaactggatctgatagtattcctaagattattcaatgcaaggttagaaaacttactcctttagagtgctggagacttgtgggattttcgtctgaagattactggctagttagaaaagctcttgaagaacaattttataacgggaaagactgtactgatacgcaaatgtataagatggctgggaatagtattgtaatccaggtagcagaaagtataattgaaagcttaaaaggaatattatattaaaaattgaggtgagaatatgggtgaaatattattagaatttctaaaagaaactcgtattataaatagacaagctaaattattaatagaagataagaatagtttatcttcttcagataaagaaatgttgaataaaattatattaaacacatctaaatctttaagtaagttaggttcagaaattaatttatgattagtttatgtggcagagattgtaatagctgtgttatgaaaaaagaaaagatgtgtaatggatgttccatgtgtgatgtttctttttgtaaatgtggtgaaaaaagaaagcgttgtatggttgtttgtcctaataaattcggttcttttactttagtaaaaaatactatagtaaaggaacccttaataggaaataaacctttagatttaccaatttatatacctgtaatgcctgataaaatcaaagaaagttttaactttaaggccaataaaaatataattgctgttcatggagagttctttttaaatgctgctggaagcaaaataacgggggcatataatccaggattcagagctgcattaaatttaaaagaagatctatccggaatattagaattttatataaaggatagaacattagaaggcttttgggataatcgaaaatctatttataaagacttaaaacgccaggactttttaggaataatagctcctaatttttctgtttatgaagatgctccacgcctggaacatatatataatattcaacgttctaaaattgtttataatgaaatgatacgtgagggccttccggctattccggatatatcttggtactcaaaagaagatctaaacttttggataagagaaattaaggccaataatataaaaactatatcttttagtttcatgaatgtagatactaaacttaaagcaagtaactcatggaaacactacttgctaggatttaaaattttaaattttaaaatacctttagatgtagaaatagtggttgtaggtatttcttcagtccaaagaattgaggaaatccttaaaataagtaaaagtagaaaaatatcttttatgcatcaagctgcttgggttaatagtagaaatggagtatctgtaaaagataaaaaacaactagataaatctatttctaaagatgatattttcaaaaataatctagaattttatactagtgagtacaataaattatatgaaaagtacagtaaataactgtacttctttttttattgctcctaggaccaataaaaataatagataagtaaagaagtgtgttaaataatcttatgaaaggggagattaatttatgcctaaaagaagaagcaatactattgcaaatacaacggaaggattaattggtggctcaggatctaatctttctgaaggaataatagaagatttagttaatgctgttaatggtagattagataatattgtaactgtacaaggattatctaggaccagaaacagaattgaagatataaatatagtttctttaggtaataatcgatatgaagtaagttcaactgaaggaggaacttacattgttgatatgaatgaaaatagctgtgaatgtggccaatatgtttatagaaatgaatgctgcagacacttaatagcggtcagagaagctttaggcgaagttgcagaagtagatactataaacaatgtagaaactactagaagagctagggatataagagatgaaataaatagaaatattcgtggggaagaacaagacgataatcacttttatacagacaatgaagttgatttcgataacgattttgcagaaattaatgacgattctatagagtatgagtacgaaaacgtactaaacggaaataagagtacatttggagttgaacttgaatttgttggtggtgatgctaatgctatagcacgagaactctatgatttaggtatagttagttctcctagaagattaggctatcactcaagaagtgagccaggcaaatggaagcttgagagagatggttccgtatccgatggagatgccggtggagaaatagtttctcctattcttaaagatactccaaagacatgggaacaaataaaagtaatatgtgatgttgctaaaagacatggggctagagtagatcaaaggtgtggtggccatgttcatataaacatggaaaaactagatactgcaagacaaagatggagaagattttttaagactatagaagtatatgaggattgtatttatagagctgcaggtggagatttaggaagagtaagaagtaatgctaggcattatgccactccatttagtcctagggccgatgaaagtaaatatataagatttaatatggataatgatgaagatgtaagaagaatggcagcagaagtttcaaaaggaaatagatattatggtattaacttaactaatatagcaagagatagagctcctacagttgaatttaggcattttaacggttcattaaatgagaagcaaatccaggctaatataaaaatggctgccggtataataaatgcttcagaaaaagctagatttagagatactgaagatgaaattttcaaaaagagaggaaatattctaaagaatacttcaaggctagatggaacacaaactaaaaagaaaatgatggagtttttagacttaacatttccacgtagaaaagataaaaatgcaatactaaatgtttttaagaaaaatgaatggagataatatacttttatagaaaataatattataatatttacaagtattacaataaataatcatttctctttttattaaactaaaataacgaaagagctctacttagtaaatctaagcagagctctttcaatgacttttattgtgatacaaaatgaatatattataattataaaaaatttataattataaataaagaaaaaattaaacgttttcttattttaaaaatttcttaacataatagcctaaatttatattataataattttaagcttttactatgtaaatagccatttttccttacgtaatttaagaaaacaaagaaagtcctacttaaaaataagtaggactttctttgtttaacttaggcacttatacataaagtcttttaaatattttaacttaaatttcaagaaaaataaagagtaatatattgtttatttattaagtttaaagttataattaaggtgtatcttttaagagtttttatatcataattatagcttttcacatttcaacttataactaagaaagtatctatttttagatactttctttttactataataagtataatattttaggagagtgattatatgaaatggtcaaaagaaaagattaaggataaaaaggaatactttttaagccaaagaaaaaatcctactggaaaatttacagaaatggttgttagaacatattttttaatttataaacaatgttctctaaatgacaatttttgtcctagtaataagataaattccaggattttagtcagcgatgtgtatgaaaatttttatgataataaaacatcaaaccatgttcctagtgtggttgatgactgtataaataatttaaataaaatgggctatataaaatttattaaaactaattcatcaccaaagtggatggtgaaaattgaaaaaaatttagattttattctagatggtgaagaagatttttacttcaaaaaatataatataactcaaaaaatagtataaaaatatgtctataaattaaaaatttaaatttataaaaaagaaagtattattgataatactttcttttttgtttttaacatataggaagtgatgatccttggatggtttaataagaagaaagatactagcctttttacaatggaatgataaaaatggttattatactgacgaacgatgtgacttggaagaagttcaaaaattatcattagaagaaagtataaaatatttttttggagtgataaattcagagttttattattcaatagctgataatatctttgagttaagcttttacgaaacaataaaatatgctaaagattataagttttataatcaaacttataaaaagttaaaattattgatagataataatcctaatgaaaatttatatagaaatttacttgaataaaaaaataaagttacttaaaaataagcaactttatttttagtgtttatatatataaaggcaaaaagcaagaaacttatagcttaacaatattatactttaaatactaaaattaataaagccagttaataaataactggctacctagatagattcaagaatcttcaaatagtagaagatataattattttacaataaaaattaataattatcaaaaatattaatttttgataaaataaaattgttaacattttttgaattatatttttaaagagcagttcaattttcgggattttgagctgctctttttactattaataatatctgcgatttgtttttaaaacaaatataaatcttaatatctttggtaaaaataaaagcataaacattcctgttaaataagctattccactataattcccaacaatataataattgtgagcagcataaaaataatacactaacattacatatctaccaagcttaattaatttcatatttgaaaaactaaatatacataaaactattaatactaaaataaaatccataatatctcaatccccttttatttattattcatgtaaaattttatgaattactccaaagctgcaattatttaaagctgcaagctcttttattgtttttccttcttttctttgagctcttataatatttttttcttcttcagtaaatctaggttttctacctgctccacgactattctttttagatttttctttaagctctaaatattctcgacttactctcattaaatccattctactatctacattaaatttcttataaattcctgataatacatcacgataatattcttcagtttctttatttttattttttaaactctcaatttctgataaaaatttattttgttcaaactcactattattcaatagtttaactgtaaaataagtgttataaccttcatttcttctttcatatatttgaggtgtcttttctattttaaaaagctttcttaattcattaattaatatttcaacttcatcttttgagttagtttcaattctaaatttaaatccttcttggccataagtttgattatatgcttcttctaattcttctcttgaatattctaaaacactaactggatatgtattaactgtataatatgatttactagatctgctgtaatattctcttttaacgggtatttcttttattgctccaattttatgaagctgatctattctttcagtattaacaccataaaaatcagcaattgtccatgtaggaatgtatccaaacttttcaaacttattaaaaatagtatcaaattctccagctacaactaatttatctataattttagatttagcttctctaggtttaaaatctattccatattcttcagcaagttttattatttcttgttttggagtgtccttattattcttaagttcatttagaaaaatttcttttaaattatccttcatatcatcaccctttatatttaatatgttaaatatattatatcataaattaattaatgaaaaaaatcttttttcattaattaatttatgatataatcaaaatataaagataagtggggaggaaatggcagtatgatagtgattgataaatctttaggtgaaataaatcctgaaagttatttaataaaaaatgctaaagataatacatatcttttagcattacctaataaccttaatggatataattattttgaagtgtacatagataaactaaatagaagtattcatgtttttgatagtctagagaatagaaaagggggaactagtgctattaatagtgtagatagaatattagaaattaggagacctttaaatttagatcttgactataagcttgtgatatattacccagatcatagtatatttaaagcttgcataacaacttatcatgaaagaaaaggatttaataaaaatagagactatgtaacctatataccttttctgaagaaagctgaattatttctaaaaaatagattttaattagagcttttagataaaactatattataattagagtataactattgaaaggagtaaattaaaatggtgtatagaacattactaaatccacaaatagattttgtgtttaaaaagatatttggtacagaaaagaataaacctatattaattaactttttaaacgcagtaataaaaccaacaactcccataaaagatgtagaaatcaaaaataacgatatagataaagattttatagaagataaatttagtagattagatgtaaaggctacaactagcaataaagagcatataaatattgaaatccaggtaaagaatgaatataacatgatacaaaggaccttatattattggagtaaaatgtattcagaacaaatacaaaatagagataactacagtaagttagaaagaactgtttgtataaatatcttaaatttcaaatatttaaagaatgataaatatcataatgcatataggctaaaagaaataacttcaaatgaagagctgacagatcttcaagaaatacatttcattgaattacctaaatttaatgaaatcggtaataaagagtatgttgaaaatgttgagaaaatggatgctttagaaaaatggttagaattcttagttgaaccagaaagtaatactgtaaggcagttagaattaagtaatgaagaaattaaactagcaaaatctgaactatatagacttagtatggatagtaatgaaagagaacagtataatatgagagaaaaggcaatatacgatagaatatctgccttagaaaatgctgaagctaaaggaaagatagaaagagaattagagttaataaaggagtctttaaatcaaggattagaaatatccttaatttctaaaataacgggattaagtgaagaagaaatattaaaaataaaaaaagatatttaataaaggaggaaatagtatgaatataattataatatgtgctattataggtggattaatgggatacttctatatgaatagaaagcttgagaaaaaaacaaataattagtaatatttttgtgataactaaaaaagactctataatttagagtcttttttgattttaattaaatttggataaatataaatataaaaata

SEQ ID NO: 28 - DNA, 64753 bp, Clostridium perfringens
atgtaataataactcaagatgccaatgataaaataatggactttatgtatgataatgcaaaagttcttaaagaacaatatggcatacaatctagaaataaattattagctgcaattatagaatttgaagcagatcatatagaaaatatatttgaaaagttaaaaagaaaggagaaataagatatgggatttagtttaagaaagtcttttaaagttggtaaaaattctaaagttaatttatcaactggagggggtgtgggatttagtacaggtaaaaaaggagcgagagtttctgtaaataaaaatggagtaaacttatatggtgataaaggtattctacgatttactaaacatattagttttaagaaaatatttagttttttaaatagtctaaacaaataaaataatcatataaaacgagttgttctccaagaacttaaataatgttcaagggggaatttttttatgcaaaaattaatgttaaaaccaccaattacaaggctaggtggtaaaagtaaattaagaaaagaaataataaaaatgatgccagaccatgtgtgttatgtagaaccattctttggtgcggggtgggtgtattttggaaaggaaaaatcaaagattgaagtaatcaatgatattgaaaatgaaataccaaacctatttaaaattataaagtatcatgctccagaaatgaaaagacttctgtcctatgaaatatcaggaagaagtatattcgatgaatataaaaatgctactttggagcatttaaccgatatacaaagagctataagatttatgtaccttataactcaaagtttcggtggtcaaggtaatcattatggttatggaactaatacattaccatcacaaaaaatctttgattgtaatttagatgagcttcaagaaagattaaaaaacacctatatagaaaacttagattttcaaaaaataattgaaaaatatgatagggaatatacattatttttcttagatccgccgtactatggtacagccggatataaagcagagtttggaataaaagagcaattaaaacttagagatattcttaaaaatatcaaaggaaagtttatcctaacaatcaatgattgtgaagaaactagaagctggtacaaggattttaatatcaaagaagttgaagtaccatattcagtttcaagacaaactgaaggaagaaaaagaaataaagaattgataataacaaactactaaaaagtagatggaaggagattaaaattatggctgcaaagttagataaaaatttaaaggaattagcacaagatttattaaaattacaaggagtagattatatagattggttaaataaaaagcaccaagaagtaataactaagaatacaaaaatcataagaaattgtgttaaaaatgaaataaaaaactcaaataaaaaagatgaagttatagaagaaattaatcaagaaagtaatgaaaatcttgaaagttttgaagatgaaaattacaatgaggatgaagtagaaagtgaacggaaggagttaatttattaggtgaaagatttaaatttatatgcaaaagaattagttgatgtagttaactatttaatgaaaaaaaatcaattagtttttagtagaaacaataagtttatttatgtaaatacagaaacaataaagagtatgttagagaaaagaaattatgatactgttgatgggaaattgtatctttggagagagttagaatggattgagtgtgcagaagataggttcaataaacgtataaaaatagatggagaaaatatgtatgcagtagttataaaatatagctcatatagtattttaaaaaggctctatttagagtaaaatatgaactttaaaatgttaattttatagggaactttagggggaactttgcaaggaactttacagggaactttaaaaatttaaattgatataaaagttccctgtattaatataagtattttaaagctatatatcattattagttccttatcgtattatagagtatatattatatatataatatatacatataatgtattggtcacaaattgtgttttaatttgggactaatatttttatatgtatatgttctatagataattttatactcttagactatagatgtatatctatagtctatacagtaaataacctatagttatttactgtataatataataagtaatttattacttattatattattttagataggagtattttcatttatgaatatatataatcttaaaaaagaaatgaaaaatattatttattctgattcttctttaagtaaaaattctattagagatagaaactctgctcttaataaagtatttgaaaattttaatcttttagatgatacttctgttattactaaagataaaattttagataacttaaattcaattaaatttaaaactaaattatctgcaggtgttaatgctattagatttttaaaagaacataatcttgatattgatcttccttctgaagatgaactaaaagagattattaaaaataaaaagaagaataatcgtaaacctactgcagagaaaaatttaattgatattgaaagaaaagttaatagagttagaaagaaaaattatagactagcttataagttaatgttagagtcaggacttcgtgttcacgaagttgcagctctaaagaaagatgatttttcttttgataaaaacctaataactattaatcttagagaagctaaaggaaataaactttgttctattgaacttgaaaataaatatttatctaaaaatattggtgagcttattgaaactaaaagtgaatatgaaagagtatttcctcacatgagatacttacaagaacaagctactaaaatgggaatacaatgtcatgatctgcgaaggggttttgctaaaagaacttataaagaagaattaaaaaatgatgtttctaaaagcgaagctttagataaaactagaataaagttacgtcatactagaagtgatactactgaaatttatttaagatgtaaaattaaagtttaaggaatggagtggaatatttgaataactttacattaaatgatttggaatttatatttatggttttaaaaaaaatcttagatgccaataaatcaaatattaaatctattaaaaaaaaggaatgcataactaaagtagacataaaaactttaatggaatatagcgaattagaaatgaatttaaaagttataatagataaaatagaaactttaattaatgaaaaaaatatttcataaagggcacttttaataagtgctcttatttttttagaaaggagtgtttttttgagtagtgattgggaaaaaaagttaatcaggaagtagaaaatggattaaacgcaattataaatgagattgccaatgttctaaaaattttcttttttagagttggattaggttttaaaaaatcttggaagaataaaaagctttttattggtttctttttaagttttttaattcctatagctgcaagaattaaaagtgattactttcttgtagacactaaattttattttaaaataatatatttttcaacctttatagctcctttattttatatggttatagtatcttttgttaagaataaggaagataaaaggaatgcagaatatagacttgcttttgaacaattaaactttgttggtgcagattctaaaacaccaattttaaagtctttcattgaagataagggtactagaattgatgaaataacctttgagtcaatgatacctattgaaacttggaaaagttatattccacaacttcaaacatctttaaatatttctataatttcaatagagcaaggagctagtaaaagaattgtaattataaaatctatggctggagatgctaagatacctaagtaccttccttgggatgataagtatatagaagagcaagaaggggtagttgttgttggacaaacttttagtggaaatataaaaattgatttaaataaaagccctcacattttatcagcaggggaaactggatcaggtaaatctgtaattttaagatgcatactttggcaactattaaaacagggtgcaatagcctatatggtcgattttaagggaggcgttgaattcggtttagagtatgaaaaagtagggcaagtaataactgaagttgatgctgcagaaaagttatttaagtatttagtagatgaaaatgcaaagagattaaagcttttaagagaaagtggttctaagaatattggtgagtacaataaaaagtttgaaggagaagaacttaaaagaattattgttgtcatagatgaattagcagagttaatggataagacaggtgttgatgatgaaactagagctaagttagtaagaatagaaggctatacatctacattggctcgtttatctagagcaactggaattaatctatgtattggagttcaaagaccagatgcaaaggtaattacaggacaaattaaaaataatgtaccagtaagaatttgtggtagatttgcagactctaaagcttctgaaattgttttaagtaatactaaggcaaaagacttaccagaagttaagggaagatttttatttaagctaggagctgatacagtacagtttcaagcattttattttgatgatgataaacattttatacctaataaaattttaaaactaagaaaagatgaaattgaagataagaaagtttgtctagatttaaataaagaaaagttaattgataatgatttaatgaatagtgtaaacgaaaaatttgaaattaaagaagttaaatctatggattcaaatattgaaaatgaagatgatagtaaatttgaaaattttgaagaacaaaataaaactgaaaatctaaaatcaactataaatgatgattatgaataataggaggtagcaatatgttttttaaaagaaataagagtaatataacttatgctaaaaaagaaggagataaagctttaggggtattagttaatgctcctaaaattttaccttggagcaataattatttagatgaaaaaaatggagttataaacttaggaacaggattaaatgattctgttattaagttagatttaaataaatctcaaaatgtattaatagctggtgaaatgggagtaggtaaaactttacttacaaaaaatattatttggcaacttgtaaatcaagagtcagatgtttatatgattgaattatctggtttttatgagtttgattcaagatatagtatgatgggccaagtgatcaatgagcttagtagtttagataatctattaaatgagttactagatgaacaagaaagaagaactttaattttagaagaagatggatttaaaagttttgaagctttcaatgaaaatagatttgattctaagaagttaaagagaaaagttattattattgataattattataatcttttaaagaaagctaatattagttcgatagagcaaatacaggtagaaagcatagagaagaacttaattaaattaataggttcaactaaggatacaggtattaatttaataatcaatgataatgagataagtgaattaaacactgagttaataaataaaattcaagttaagatttgtggtagacataatgagcgtaactctaaattaatgctaggcgatgatagagctagagagttaaattgtatagcaagttttcttatgaaaataaataatgaaattgaattctttgaagcttatcgttttgaggaagaaaagcagttaaagattttagagtcaattaaaatagacggtgtatttataggcaaagggtgtgatgaaaatgaaaaatagtgcaatagaaaattttgaaaaggcattagcagagctttgtcgttctgcaagaaaagaaaatttaaatgtaaatcttgatgtttacaaagataaagaaaagaaaaagaattactatggcatagtaattagagataggagtgaggattatgtttagaaagaataaagaaaatactaagcctaaaaaagagaataaagaaaaaaagtctttctttaagaaaaaagataaacttaacatggatcttgaggattcagttgctaatttagataagcaggttaatggtgttaaggagaaaaaattagtaagtgtaatgccatttagaatagcaagagcttttatatgggttcttataggtattctttgttttaggggtggagtttcagtctttaaaggtaatcaatctgaagctttgaagaaagaaaatgaaaagatattaaataatatggagaagcaaagttcacttgaaactcaagccttttcttttgctgaagaatttgcttgggattatttttctagatatccaattaatacacaagattttataaatagaataacaaagtacactacagagcaactagcaaatgagatgaataatggaacttattcagatgtcatttatactagtgctttttattttgaaaaatattctgaaaatcaagttaacgtaagtgttaaagctagagtaagagtttatacacctaaagctggtcaagagcaaactccacaggaccaacttcaatatgatactaatttagttgattactatttagaagttcctatagttttcgataaagatatgaatatggccgtggatgcattaccagtaatgacagctccaccagagaaagcttatttcaaaaataaagagttctccggaactagcgaaaatgatgctgataaaactaaaaagattacagatagtgtatctcaattctttaaggcatattacgagcaaaatcaaacacaaatagattatttcttagttgatggagcagatattaagggagcaggtcaaaagttctcttttaataaaatcgatagaataaatatttataagcttagtgataaagaattcttggcaattgtagacctaaatatagattcctttggaaattcaataaaacaaggatttaaccttactgtagttcaggaaggagacaagttcttagttaaaactttagagccaagaacttcaaatatagatttaaataataagagcaataattaggaggatttattatgaaaaattttaagaatttaaaagagaaagcagcagagaaagtaaaattacacaagttaagaatacaaggattttttgtagcattaatagcttttatgacaacctataacacttatgcatatgctagtatagatggaggagccataaaaactaatgtaataaacaatattttattacctatatcttttgttgtagttggatttctattaataaaagagcttgttaaaaagagtattgcaggtatagtagttgttctaattgtaggtggattggtaattgtagttattgctcaaccagatttaataaaaatatttggtgagtgggttagaacaataggtggtttttagaaggagatttttatggaagaagaaagaaaaattttaagaagctataataagcttaaaaactttgaaattaaaatttatagattaggaaatactacaataccttttccacttcctataactactacagtttattttttagcagcattaacattagttgctattatagatgctacaattggaatacacataaattttatatataagtacgttgctttacctttaggtatagcctatatagcaaaaaataaaaaaatagatggaaagccactgcataagtatttactaagacttatacagtttcaaaatatcaagaagtctaaaatagaaagatttgagattcgagagaatttagaaagttttagatttatagaaagattttagagagttagtttaaactaactctctttattttattccaagttggaaaggagtattcttatgaagaaaaataataaatttgatttttaataataaagcctgctatgcaggatttaaacttaatggatttgaatatagttcttgtaataatagtgaaaaaattaggatattagatagtttaaccgaacttataaaagaaatacctagtgaagctcaagttttattaattccaagagcggtggattgtgagagatccataagacctatgataaataaaatccaggaagatgatcctttgaaagaagtttcaacaattttagctgagaaaactatagaaattttagaagaaagagctgaggatagatatatatttaatcctgttactgaagaaaatgagtttattgccggggataaaacattagaatatgacacatatatatttatttcccttctaaaaggcgacgataaggattttatttctaaaggagtggaaatattcgagtatatgataaaaagccctaaaaaggctttaaacgagtttttaggcatatctcagaaaactatatctgaaagagactttagaatttataagaaaaagtctacagaatttttagaaatacaatctatgagatttgatatacgccctttaagaaaaagtgaaatagatagtttaagtgccagggttactaaacgtggtcatcaatcagcggatgagcttgttaagtggagtgataactgcttagaagtagagcaagatgaggaaaaagttattattcctttaagaaatgcctataaaaatagagttacgggcctcatagagcaaggggataaaatattaaaaatacaaaatgatggatttacaagttatcagactttcttggccataaataatattccaagtatggagtttccgggggttgagtatataaagttaatccaggatatgaatattggtgcagagatatgtattcacataaagaagttttctgcggaagaaagcaaaagtaagataaaaaataaagctgctaagataaatgcacaggtaaatgaagcactccaagggggacatataccatctgatgaagaatacgaagcgaaggcggccgcagagtcgttagaaaaggaagtaaagagaaataaacatataatcgaaacaagtataagtatttgtttagcttccacaaaggagaaaatagttagaaataatacaaaagtccttatggaatatttcaataaatccttaaaatttgagcttataaatccatatacagatcagtatagaattttcttagattttataccagctaactctaattataatagagatttcatacagctagttccaatggaaacattagcgggtggagtatttggagctagtgaccatttaggagatagcgtaggagcctatataggctacacagtaaatggtaatagaaaggtttatttatacatgggaagagctacaaagttaaataaatcacctgctatggggatatacggtaacttaggtggaggaaaatcttttaatgctaacttaattgtagttttacacgtgcttttcggtagttccgcacttatttttgatcctaaaagtgaaaggtcacattgggctgctaaactagattttatgggagatttaataagtatagttagattaacacctaacgatgaagataagggtaaactagatccatttaacctttacaatgataatatagatgaagcttgtgacctagcttttaacataatagttgaaattgtaaatacaagtgaagaagaaaaaataattttaaaagaaacattaaaacaaataagagaagaagaaaagccttcaatgaaaagattaattgaaaagattaatgatgtaccagatagtgatgcttataaaaaagatgccgagcgtttagtaagaaagttaaatgcatcaaaggatgtaggtttatctaaacttatttttggagatggtactgaaaaagctattaatttagataataggttaaatattcttcaaatagacaatctaacaattccagatcaaggtacaaagaaggaagaatattctgaagaagaaaaattaagttcttgtttaatgatgcttatgggaagttttacgaagaaatttgccatgaaaaaaagaaataccttcgacttaatactatttgatgaaagttggttttgtgcgagacgttcatagttgaaaagactatgcacattctaaatataagagaatggagaactcttaacttgaaaagtggaatgatagggtaacgccttgaaacgctttctctaatactccgacatgcagtaactttgtgtgaaagttattgtgtgaagctcggtgaagtcggcagaaaattaccgtagcagataataaaatgttatctaacgaaagtgttctagaggtagaatatgtagttgatatgccgggagtcattaaaaacagaatatggtgagaatgttctaataggaactgacgaactggcgaaggtacgctccaaagcgataagtatagaaatgtatgttaattggtttgaggatgagtaaaaatgtaacccatgaaaatccttgatatgttataggcatatgataagccaatggggtaaagtcagcacctaagttctagtattgataaagttaagggaacgtcgaaagctaaagacgtggaggatacacacctatgaagcgaagaaagggaatacataacctttcataatctttagtgagagtagtggcatgactgatgaagattttgtaatgaaattggaggaatagccacaagtcaattatttattgaaagaaacttaatcaattcatggattctagtaagataaaaaaggtcgctaaatatatttaaattagtgatagaccatgacaagatatttatattaatacttgagattaagaaaaatgaattcaatatataattgatggaacgccgtatgcggtgaaagtcgcacgtacggtgtggagcgggggaaaaattggagataatatcaaagatttacctatcgctattgaaaaattctgctgcaggtagaaaattatatgactttttagcaagacagggaagatccttaaatgttggatgtatatttaacgggcattctgttttagatataccaactgaagaaattaaaaatactataacatacaaattatgctttaaaactaataatagagatgaagcaaagagaatgcttgaatttatgaataaaagcattactgaagaaaatattaaaatgcttatggaattagaaaataggcaagctgttttccaagacttagatggaagggttggagtaatagaatttgatgctgtttttgaacagtttatagagtgttttagcacaacaccagaagataccttaaactatgaggatgtttcttaatgaaaaagctttttatatggagtggaataatatctttgatatttccacttctattttttttcttaattatagggggaagtggtgaacagccaactccagtaaatcctaatcctaatttaacggaagagcagcttaattttataagtcagattgtttccggagcgaagcaatcctatgaagaaacaggaatatttccatcaataaccctggcacaagctatattagaaagtggttggggaaggtctgggttggccataaaagctaataatttatttggtataaaagctgactctggatggaaggggaaagttttagaaatgccaactcaggagcatgttaatgggggaataataactattatagcaagatggagagtttatgaaagttggaatgaatctgtaatagatcatggtaaattctttgtagaaaattctagatataaagaaaatggagtcctggacgcaactaactatatagagcaagctcaatgcatacaaaaagcgggttatgcaacagatccaaactatgcaaaccaattaatccaggtaataaatgattttgggctaaatctttacgatatgaatggagatgttgtagggaatgatgttatagaaaaagcaatagaagctggaatgaaatgggttggcaaatccccatacgtttggggaggcggtcgtaaccaagctgacgttgatgcaggacgatttgattgtagttctctagtacattattgttatgcatctgcaggaataactttagggccaagagaaagtgtaacaacatggtccttaataaacatgggtaagcctgtacctgcaagtgaaatgaagcgtggagacttaatattcttcgatactgctggaaggaacgggcatatcggcatttaccttggaaatggtaaattcctaaatgatagttctacccaaggagtaagtattggagacctaaatagtgcttattggagcagatattttaacggaaatgtaagaagagtcgtagaataaaaattcggctttaagaagaaaagtacctggataattatcaatatttttaaaaatatccaggtacttttttataaatttacgaacattaatcggaggtgtgaaatggagaatgtgaagattaatatatatagtaaatttctgtatttgaaaaataaattaacttataaaaatatattaaaagccttagttataattgcaactatcgttatagcttacaactgtttaactaaaatagcttatgcagatggatttttaagctatggtaatagtgatgatccttataaaagcattcaggaaggttgggggcagtttattgctgataaatatagaaataactatgctttagatattatagatactcatggttgggagcttatagataaagctataactggactaactaatatagtatttagcggaatagtaatgattagttggtttggagtaaatatatttagattttgctttacaaatgatatagctgcaggctttgcaaatcaattaaatagtgtactaggttctctaaataatgggattttcaataatttctttatgatagtatttatgatttcactattttcaatagtttataatctatataaaaagaactttagtgccataggatcacaaatactagcagtagccataatatatgcaacaacagcttttctaagtaatggagctgttggcttcttatctaaaacaacggagttctctaaaaccataggaactagtgccatagttgctataaatggtaaagaaaataatgagggttccttagaagattattctaaaactgttgtaggaaccttatgggggaatttcgttcaacaaccttgggtaatgctagagtttgatggtaagttacaattaatgaataaagactctataaataaagaagcattagattattctaaagatatattatcagagccttatggtagtgatgaaagagagaaagcactaaaatcaatagatgaaaaatttaataatgagttgttttcaaagaatggcataaatactaagttagtatctgtatgtgtattattcgtaataactttaataaagatgattattttaatagctgtaggaatgatacaaataggatttcaacttatgtcaattcttttaatattgctacttccatttattatgcttattgccatagtgcctttctttggtggtacaaatattataaaaggaatagcaagaaagtatttaggaactcagctcggtataattgttagtagctttgtattagccttactggttcttgtagatactgttacaattacaatgtttcaagcttggggagctaatttaataatagctcttttaatgcagtgtacttgttggatcatggttattgcctttagaaaacagttaatgaacgggttaataaatcttcaaaatagaattgctccaggaacagcaggagcatttaagtttggatctaaaacactagataaaagtgctgatattacaaaggaatatgcagtaaatccagcgatggataaagcctatgacataggagataatttaataactaaagctcaatatgctaaagaatatacaaagggaaatttaagtctttacaaagatagaaaagtagctcaagctatagaatttcttaaggttctaaatacgataatttaaaaaataataagactgaagatatagagaattctaataatccaaaagaaaatatagataaagttaatgataccaaaaataaagttaactcaaatgaaaatataaataaaaaacctgtagaaaaatttgatttaaatggagttaaggccactaaacctagtaatataacttctgaaaatattcctaacaagaatattaatgacgaaaataaacctaatattgatgaagaagcagttactaaaaatgatataaaagatcctatagaaaataaggatatagctcctaaaactatagatgaaaacattaaaaataacggaaatgatactggaactatccaggatgaaagtccaggaagtaaagaaaataaaactattcctgaagatgaggaaataactacaaaaccagaagaaataaaaactcctgaaaagactataaataaagaaaatctaaatgaactaaaaaatgaaaatacatctgcagataagaaaaataatgatagtaatattagtaatacaactgttactgaagttcctgaagatttagtggaagaaaaatctgttgaagctataaataaagctaaaaatgatattaaagtaaacaaagaaaaaatgaataataatataagttctaagaatactgaaatcaatccagaagcaaaagaaaacatagaaatagcttcatcaccagaagttacagaaattaagaaaaaatctactaagaaagttgaaaatatcaaaaataatggacaacaaaaagaaaaatctccagataaaaaacaaattaaagaagtatcaactaaagaaagggttgagagagtaaaatcatttatgggagtaagtaataaggatataaaatctaaagaaaagcatttagaaaataaattagaatacattaagaaaggaaatagcaaaaactttaagaagaaggggagctgattatgctatataaaacacatttattaacatcactaaatgttgcaataccagctttatatctaagcaatgagttatcaattttaacattaacgggagtaggcttagggagcctacttccagatatagatactccaaatagttttattggaagaagattaaagataatctcatatccattaagtacaatatttaaacataggggatttcttcattcaatagctcctgtaatattaatatttattttaggcatatttttaaaatcactatttataaaatctattgctttaggacatttactacatttagtaggagataccttctcagaaagcggcataaagtggtttttacctttttataataaagatattaaaatgccattaggtattataagatatagaaccggtggcctaaaagaatatgttatactaggaataagcattgtaatattaatgctagaaatacaaaaatttcatttaataaacttattttcaatataggaggtaatatgaagaagaaattagtatttttaggtctaatatgtttaagtttatttgctttcgtaggttgcggaactgaaaaactagatataagtaactgcatagatgtacgatatggagaatttaacggttcagctaaaatctatgaaagtagtttaaatttaggaaagctacaagatatccctaagctaaagggacttactcctgatatgctaaaaggagactataaaataactttagtaggagacaaaacagatttaaagaatggagataaagttaaactacacttagaatacaacaaagagctatataaaagagactttaatgtagaatttaaatttgaaccaactgaagtaactatagaaggtctaccagataaattaacagatataaatcaaatttctaaagagcaatgggaaaaaatatattcagcagctaataaatattttgagaatatagctaaagaaaaaaattttaacaactttaagttagaacgtattttaaaatttgaagataataatacaggaaaaattgatataggatttatatattcatataaatctaataataatgaattaagttatatatgtttaaatgattcccttaaatttaaagttgataatgaattagaatataataatttttctataaacttagctcttgattcaatttggtttaataaattttttattgattattctaaaccattaaatgaaatattaaataatatttatactaatgtttataagtgtaagtattcaattttatggagtgcagaaaattaattttttgattgtagattataaaataacgatgataatataaatttatcatcgttatttttataaaaaattttggtaatatattgtctaattttaggaaatattgtataattaatttactcaaggaaaaagataaaaatactataagaaattaataataagttatatactcgtttaaattacatatataaatttttcatagtttaaaaattttgatttttactatgtttatttgttatgtaatttaagcgagttctaaagtccaagctcaaggaatttgagtttgggcttttttatatgcttttttagagtatagactacaaatctatacagttgcctataacttaaataggagcatggtaaagccgttgtgataacgtaaatatttaccggagtgagcagatacactataaactaatcttagcgaaagctaacaagggtttgattgagccaaggaagaaagttaatccggctattctcatattacacatatatgagggtataacgtaagtcttattgaaactctgatgaagatgtttagtctaagtagctctataagagttatatgacaaaattcagcggttacgtggagtacctgcagcttaaaaataagctgcaacgaaaggaacgtacagaacagtagaaatactggacaggtaggggtacaattcctgttttgatgtacggattaggtgaaatactaatcactaatgtgttgttaccgggaccataggttaatgtggcgaggctctgcatagggatcttaattcggtgacatagttatcctgttcttttttaattaaatcggacaggataactatgtacattttgagagtactcgggatctaatcattaaaaacttaaaaagtcaatatataaattaaatgtaaatttgaatttatttagatattaatagattttataagaagtaaagtgatggtgaagtaagatgaataagagaaagtgtaccttatgtaagaattttgataaatataaagaattcaattgtatgtattttaagataaagatagaagatcctgaagtagcaacaaaatgtactaactttattccaaagagaaaggaaagtagaaagccttgtaaggattgtgtatattacgtacgtaatccaaagataattcaagttaagaagaataaagttgtttttgataaaagattttattattgtctacgccttaataagcgtgggacttattttagaaaggttaattgtaaatacttttcagaagaattataaaggaggaagagtttatgaaggtattaagtttatttagtggaataggagcttttgaaagagctattgagaataaaaatattgaacatgagatagttaattattgtgaaaaggataggtacgcaagttatgcctatagtaaactttttaggttatctgaagctaagaatttatgggatgttaattgggttgatggaacacaatttaaagatatagatcttgtaacttatggattcccatgtgtcgatataagcttagctggaagctgtaagggaataattaaaggtgaaacaaaatctgggctgctatttgaagcactaagaattatagaaggagctagacctaaggtagcaatagcagaaaatgttagaaatttagtaagtaaaatgtttatttctgattttcacaatttaattaatgaattggataagttaggatataactcctactggaaaatactaagtggaattaactataattcagctcattctagagaaagagtattcatagtcagcatcaggaaagatatagacaacggaagctttgagtttaaggaaggaaacgataatctagttaccctagaaagcattactgaaagctttgtagatgagaaatactattgtaaagataattcttatttaaaaagctttttaaataaggttaataaaagaatttgtaaggataaagagcctagtaaattcggattaatgagagttggaacaattaaaaatccacatatgttacaaatgaatagaagagttttctcagagctaggggctagcccaacacttgtaactggatctgatagtattcctaagattattcaatgtaaggttagaaaacttactcctttagagtgctggagacttgtgggattcacatctgaagattactggctagttagaaaagctcttgaagaacaattttataacgggaaagactgtactgatacgcaaatgtataagatggctgggaatagtattgtaatccaggtagcagaaagtataattgaaagcctgaaaggaatattatattaaaaattgaggtgagaatatgggtgaaatattattagaatttctaaaagaaactcgtattataaatagacaagctaaattattaatagaagataagaatagtttatcttcttcagataaagaaatgttgaataaaattatattaaacacatctaaatctttaagtaagttaggttcagaaattaatttatgattagtttatgtggtagagattgtaatagatgtgttatgaaaaaagaaaagatgtgtaatggatgttccatgtgtgatgtttctttttgtaaatgtggtgaaaaaagaaagcgttgtatggttgtttgtcctaataaattcggttcttttactttagtaaaaaatactatagtaaaggaaccattaatggggaataaacctttagatttaccaatttatatacctgtaatgcctgataaaatcaaagaagactttaactttaaggccaataaaaatataattgctgtccatggagaattctttttaaatgctgctggaagcaaaataacgggagcatataatccaggattcagagctgcattaaatttaaaagaagatctatccggaatattagaattttatataaaggataggaccttagaaggcttttgggataatcgaaaatctatttataaggaattaaagtaccaggactttttaggaataatagctcctaatttttcagtttatgaagatgctccacgcctggaacatatatataatattcaacgttctaaaactgtttataatgaaatgatacgtgagggccttccggctattccggatatatcttggtactcaaaagaagatttaaacttttggataaaagaaattaaggccaataatataaaaactatagcttttagtttcatgaatgtagatactaaacttaaagcaagtaactcatggaaacactacttgctaggatttaaaattttaaattttaaaatacctttagatgtagaaatagtggttgcaggtatttcttcagtccaaagaattgaggaaatccttaaaataagtaaaagtagaaaaatatcttttatgcatcaagctgcttgggttaatagtagaaatggagtatatgtaaaagataaaaaacaactagataaatctatttctaaagattatattttcaaaaataatctagaattttataataatgagtacaataaattatatgagaagtacagtaaataactgtacttctttttttattgctcctaggagcaataaaaataatagataagtaaagaagtgtgttaaataatcttatgaaaggagagattaatttatgcctaaaagaagaagcaatactattgcaaatacaacggaaggattaattggtggctcaggatctaatctttctgaaggaataatagaagatttagttaatgctgttaatggtagattagataatattgtaactgtacaaggattatctagaaccagaaacagaattgaagatataaatatagtttccttaggtaataatcgatatgaagtaagttcaactgaaggaggaacttacattgttgatatgaatgaaaatagctgtgaatgtggccaatatgtttatagaaatgaatgctgcagacacttaatagcggtcagagaagctttaggcgaagttgcagaagtagatactataaacaatgtagaagctactagaagaactagggatataatagatgaaataaatagaaatattcgtggagaagaacaagacgataatcacttttatacagacaatgaagttgatttcgataacgattttgcagaaattaatgacgattctatagaatatgagtacgaaaacgtactaaacggaaataagagtacatttggagttgaacttgaatttgttggtggtgatgctaatgctatagcacgagaactctataatttaggtatagttagttctcctagaagattaggctatcactcaagaagtgagccaggcaaatggaagcttgagagagatggttccgtatccgatggagataccggaggtgaaatagtttctcctattcttaaagatactccagagacctgggaacaaataaaagtaatatgtgatattgctaaaagacatggagctagagtagatcaaaggtgtggtggccatgttcatataaacatggaaaaactagatactgcaagacaaagatggagaagattttttaagactatagaagtatatgaggattgtatttatagagctgcaggtggagatttaggaagagtaagaagtaatgccagacattatgctactccatttagtcctagggccgacgaaagtaaatatattagattcaacatggataatgatgaagatgtaagaagaatggcagcagaaatttcaaaaggaaatagatattatggtattaacttaactaatatagcaagagatagagctcctacagttgaatttaggcattttaacggttcattaaacgagaagcaaatccaggctaatataaaaatggctgcaggtataataaatgctgcagaaaaagcaagatttagagatactgaagatgaaattttcaaaaagagaggaaatattctaaagaatacttcaagactaggaggaacccaaactaaaaagaaaatgatggagtttttagacttagcatttccacgcagaaaagataaaaatgcaatactaaatgtttttaagaaaaatgaatggagataatatacttttatagaaaataatattataatatttataagcaatacaatacaatataataatcatatcttttttaattaaaaagatataatggaagagctatatttagtaattctaagtatagctcttttaattaattttattgtgatacaaaatgaatatattataattacaaactaattttaaacgttttctcattttaaaaattattaacataataaacaaaattatagtataataaatttaagctattattctctaatagttatttttcctttatttaaaattaagaaaacaaagaaagccctacttattttaagtagagctttcttgttttaaattaggcaattatacatgaataaagtttttttattttaactcaaatttcaataaaaataaagaataatttattgttttttcattaagtttaaagttataattaagatatagcttttaagagtttttatatcataattatatcttttcacatttcaacttataactaagaaagtatctatttttagatactttcttagttatttttatataaggagtgatgatccttgaataatttaataagaacaaagatactaacctttttacaatggaatgataaaaatggttattatactgacgaacgatgtgacttggaagaagttcaaaaattatcattagaagaaagtataaaatatttttttggagtgataaattcagatttttattattcaatagctgataatatctttgagttaagcttttatgaaacaataaaatatgctaaagattataagttttataatcaaacttataagaagttaaagttattgatagataataatcctaatgaaaatttatatagaaatttacttgaataaaaaaataaagttacttaaaaattaagtaactttatttttagtgtttatgtatttaaagacaagaaaaattaaatagccataattattataatttaaatatcaaaattaataaagccagttataataaataactggctcccagatagattcaagaatcttcaaatagtagaagatataattattttacaataaaaattaattattttcaaaaatgttgattactgataaaataaaatggtcaacattttttttattatatttttaaagggcagttcaattttcgggattttgagctgctctttttattactgataatatctacgatttgtttttaaaataaatataaatcttaatatctttggtaaaaataaaagcataaacattcctgttaaataagctattccactataatttccaacaatataataattgtgagcagcatagaaataatacactaacattacatatctaccaagcttaattaatttcatatttgaaaaactaaatatacataaaactattaatactaaaataaaatcaataatatctcaatccccttttatttattattcatgtaaaattttatgaattactccaaaactacaattatttaatgttgcaagctcttttattgtttttccttcttttctttgagctcttatcatatttttttcttcttcagtaaatctaggttttctgcctgctccacgactattctttttagaattttctttaagctctaaatattctcggcttactctcattaaatccattctactatctacattaaatttcttataaattcctgataatacatcacgataatattcttcagtttctttattttttaaactatcaatttctgataaaaatttattctgttcaaactcactattattcaatagtttaactgtaaaataagtgttgtaaccttcatttcttctttcatatatttgaggtgtcttttctattttaaaaagctttcttaattcattaattaatatttcaacttcatcttttgagttagtttcaattctaaatttaaaccattcttggccataagtttgattatatgcttcttctaattcttctcttgaatattctaaaacactaactggatatgtattaactgtataatatgatttactagatctgctgtaatattcccttttaactggtatttcttttattgctccaattttatgaagctgatctattctttcagtattaacaccataaaaatcagcaattgtccatgtaggaatgtatccaaacttttcaaaattattataaatagtatcaaattctccagctgcaactaatttatctataattttagatttagcttctctaggtttaaaatctattccatattcttcagcaaattttattatttcttgttttggagtgtccttattattcttaagttcacttagaaaaatttcttttaaattatccttcataccatcaccctttatttttaatatgttaaatatattatatcataaattaattaatgaaagaatcttctttcattaattaatttatgatataatcaaaatataaagataagtgggaaggaaatggcaatatgatagtaattgataaatctttaggtgaaataaatcctgaaggttatttaataaaaaatgctaaagataatacatatcttttagcactacctaataaccttaatggatataattattttgaagtgtacatagataaactaaatagaagtattcatgtttttgatagtctagagaatagaaaagggggaactagtgctattaatagtgtagatagaatattaaaaattagaaggcctttaaatttagatcttgactataaacttgtgatatattacccagatcatagtatattcaaagcttgtataacaacttatcatgaaagaaaaggctttaataaaaatagagattatgtaacttatataccttttctgaagaaagctgaattatttctaaaaaatagattttaattagagcttttagataaaactatattataattagagtataactattgaaaggagtaaatcaaaatggtatatagaacattactaaatccacaaatagattttgtgtttaaaaagatatttggtacagaaaagaataaacctatattaattaactttttaaatgcagtaataaaaccaacaactcccataaaagatgtagaaatcaaaaataacgatatagataaagactttatagaagataaatttagtagattagatgtaaaagctacaactagcaataaagagcatataaatattgaaatccaggtaaagaatgaatacaacatgatacaaaggaccttatattattggagtaaaatgtattcagaacaaatacaaaacagagataattatagtaagttagaaagaactgtttgtataaacatattgaattttaaatatttaaaaaatgataaatatcataatgcatataggttaaaagaaataacttcaaatgaagagctgacagatcttcaagaaatacatttcattgagttacctaagtttaatgaaattggcaataaagagtatgttgaaaatgttgaaaaaatggatgctctagaaaaatggttagagttcttagttgaacctgaaagtaatactgtaagacaactagaattaagcaatgaagaaattaagctagcaaaatctgaactatataggcttagtatggatagtaaggaaagagaacagtataacatgagagaaaaggctattcatgatagaatatctgctttagagaattcaagagaaaatggtataaaagaaggtattgaaaaagttgtaaaagaatcattaagccaaggattagaaatatcattaatttcaaaaataactggattaagtgaagaagaaataataaaattaaaatttttttattaatactaaatcatttaataccagtaaactaaaattacagtaattaaataaattttaaattaaatttgtttttaaaacaataaaaatattaaataattttattagtaattaacttttatttaaaaaattcaagattggaactttttataaaaaagttgataaaaatatctttagtttttaatctttaagttactttttattacctgttaaattttcaaaaaatagcataattagaaattgatatcactaaaagttataatctaagcaaaacttagtatttcaatgatatcaaagttttctctaaatatgcaggtattacgcataaaatgtacataaaaagtgcagattctatacatgatttttttagtcaagtttttttgattgaatttaaaaattttattttcaaattttagagtttttttattttatataaaaaaactaattgataattgacattgtttaagaaataattttaatttaatatatatatgttggttaaaatgataatgaaaatttaaataaataaaattagttgtatttatttaaggttttattattaatattatttaagacttcataatcaatatattttatattctgattaggttcattatgttaactaagaaagtcgatattaaaaaatatcgactttttttattttttagatttatatttttaaaattaaactctttttatatattgcttataaaaatattcttgaactactttccataatggtaatgcttgactagaaactgtatttattatccatattaaatacattcctttgccgctatctattacatagttaggaataggaactctttgattaaaaaaattcttttctaagtccattaatacttgatccttagttttataataatccaagtctataataatgtatttaattcttttattttttctagccttctacaaggcttatagaacgtatttaaagttatataaatgttttccactcatatttaagtcttttaattcagcgtatttatagtaccattgactatatcattttttatctataacacttctagttatccaacccttactattactatggacattacctatatagttttccttattcacttgtaatgcgtgtcccactcattcacctccccttttgtaaaaactaagaaaattatatcatattttcaataaggggtatcgtccatagccatcaacctaagaaggtataaaatatcaattaaaatttagagtggaatttttactacaattggattaaattatataaaatcataaaatttgtatttttaagtaagctaaaaaagcctataaatttttagtagtaaatttataagttattgaatcaatattattattaaattgcaactttagctgatttgaaagattttaatttaatgagttttaatatatcaaaagctgtttttttatgatttttcttagattttattccaaatcgtttaaaattacgtaataaggtttttaaaattctactaatgtaaaattctcctttgaaaatctcaagggagagcttaggaaaatattgaattaaattccccaaagccttaagctcactaatttcttcattatcttcttctaaaataatagatttaaaagtaaaaacaatggtagatgctaatagtaaagctattagtcttccatataaaaagcacataaatcgctataatctaacctttttcacttgattaattttaaatatagatttccacactttaaatattatttctatttgccatcttaaagaatataactcatgtacttgattcatagtaataatattactagatacattggtaatataggcatttatgctattaaaatctaatctcctttgattcaatgttaatcttttcttttttataccttcaatatgattaaatattcttttagatttattttcttcagttaattttgttataattaatctgcttttaagctcttttttagagctaatatagatatcattaagttcaattgtttcgccttctaccaaaggcctttgctaacttaataatatctatttttatatactcattagacttttttatagttccaaccttatatttttcaggatttggatttttcatatataatgaagtattgctttttactttcgatataaaaaatgtcccacttttatcaaacctttttaaataatcaattttaaaataccctaaatcatctaattttaagtctttataatctttatattttttcattgttttcaaatactaaacatcattttttatgcctgaaaatatatcgatattcataaatgaaccggttaacaactcatattgcaactgtacttttattgatgatggagaagcgactcctccggaacccggaaacttctttttaaactttttagataaagtaaaacttgtagaatcatttattattactctatcaaaatatgatcttaaagtatgttctaagttagttaatgtattattttgagaatataaaaatttaataaatatttctttcataaattcaattgagtgtttattaaaacgtttatctaaatcctgtttagatatttgcttagaaaataacatataatattttgaaactagttgtgatagagcagtacatatatcggagccgtagaacaaattaaacatcaaaaaacctttagctgttatactgcattttcttttaatgaattttgtattttttgctattttatttatttcattaatatcaaaactttcttttatatttttagataactatttagttttttgttcataaaattaagcctcattttctataataattaattaaatattacacatcattatagaaaataagacttcttaggttgacggctatggacgctaccactattggtgtcatgagagagtttaaattataaatttaaattgtggaatctttataacttagataataaaatattttatattaatctatcagatacttaaattttatatctttattacacttataaaaataacgttttcaatatattatgcataattggtcaaaattcgtacataactggaatatttttatttataaagtaaataatttgtttaaaatttttcttaaattcttagaatacataaggatcgtttttagttctatttaaataaacgatttaataataaaaatttttaacttgggttttgtcgtaaatgttggagctaccccaatataataaaatttgtatattaaataattttatttatattatttactttttttaaaaaatatagtaaaatatagaaaaatatattaatgaaagggtggttttatgaaaaaaaatcttgtaaaaagtttagcaatcgcatcagcggtgatatccatctattcaatagttaatattgtttcaccaactaatgtaatagctaaggaaatatctaatacagtatctaatgaaatgtccaaaaaagcttcttatgataatgtagatacattaattgagaaaggaagatataatacaaaatataattacttaaagagaatggaaaaatattatcctaatgctatggcatattttgataaggttactataaatccacaaggaaatgatttttatattaataatcctaaagttgaattagatggagaaccatcaatgaattatcttgaagatgtttatgttggaaaagctctcttaactaatgatactcaacaagaacaaaaattaaaatcacaatcattcacttgtaaaaatactgatacagtaactgcaactactactcatactgtgggaacttcgatacaagcaactgctaagtttactgttccttttaatgaaacaggagtatcattaactactagttatagttttgcaaatacaaatacaaatactaattcaaaagaaattactcataatgtcccttcacaagatatactagtaccagctaatactactgtagaagtaatagcatatttaaaaaaagttaatgttaaaggaaatgtaaagttagtaggacaagtaagtggaagtgaatggggagagatacctagttatttagcttttcctagggatggttataaatttagtttatcagatacagtaaataagagtgatttaaatgaagatggtactattaatattaatggaaaaggaaattatagtgcagttatgggagatgagttaatagttaaggttagaaatttaaatacaaataatgtacaagaatatgtaatacctgtagataaaaaagaaaaaagtaatgattcaaatatagtaaaatataggagtctttctattaaggcaccaggaataaaataagattatttattagaagtaaaaataagattttagttttatagattaatattaattctaataaaaactctatatagatttgtatgtaatctaattttcctcttaaagataaattagactttcaaaattaaaactttgtaatcttaagtctaatttgagagtgtaaaatagtctgtgtaaactaataagatgatataattaaatatcatataaaaggagggtgcacagactatatcttatgccgaaaaagaattgataaaacaactaatatagagactgctgaatatgctcaaaatgttattaaaagtttatttggtggtttaattcaacaaatacttgaagctgaaatggaagaatatttaggatatttaaaatatgattattcaaataaaaatactactgattctcgtaattgggaaaatgagaaaactgttaaatttgatttagatatcccaagagatcgtgagggttctttcgaaccacaaatcgaaaagaaacatcaaactactagaaagttcaataataggggggaggtatgcgaaaggcatgtctacacgagatatagctactcaagttaatgaaatgtacggcatggatgtttcacctactttaatctcaaatataactgataaaataataccttctataaaagaatggcaatgtaaaccattagaaagtatatatcctatcgtttttatggatgctattcattttaaagttaaaaaagataattttatagttaataaggctgcttacgctgctatcggtgtaaatattgaagggaagaaagatgttttaggtatttggattggtgctgctgaatcttcaaagtactggttacttgttttaaatgaattaaaaaacagtggagttaaagatattcttatagcttgtatagatggattaaatggctttaaagaagctataaaagccgtatatccgaatactgaggtacaacgttgtattattcaccaaattagaaattctagtcgttatttatcatataaagatattaaagagtttaatgctgatttaaaactagtatatacggctgtaaacgaagatgctgcacttcaagctctaagttctcttgaggagaaatggggagataaatatttacttgctataaaatcttggagaaacaattgggaggagctatctacattctttaaatatccaccggagatacgaagaataatatatacaactaatgctatggaaggctataatagacaattaagaaaagttactaaaactaaaacagcttttcctactgatgaagctttacttaaaatactttatcttgtaacaatagatataacaaaaaaatgggttcaatctattaggggatggcctcaaatcttagcacaactttcaatttatttcgacgaacgtcttgacaaccatttatattaaaaaatttaatataatagctttagtttttgtacaatttatattaaatataattacataaaaagaaaattaaggtttaaataaaatgctatctaaacctcaataaattttaatatatttttttagatagtttacacaaaattattgacattctcaatttttattttgaaaatttaaatttttgatttgaattattagaatactttctttgatatacctttatattgttctcattactaggatcatttctttggatatcaataactaaattttcatttttagcactttttataataaaataaccatctggattttgttccaatttccaaaattgttctattatatttccagcaaatgaacttacaactacattttcttggtctcccaaaacatttaaagctaaaactattcttggatcataaacacttgcaattgtataggcatctttagaaggatgatatttaaataaccattcttgatttttttcatttttatttaaaaatatatttacattataattccatgtatcagcagttaatattttattctcgtctaatttagatgatattttaaattctccagataaaaaatttagcttttcatttgtttttacgactctaaattattgagttatatcatcattcatgtattcagtttttatataattattatctagattaaatgctattctattagttggattaagcgaacttacaatcctataatttttatttagtaatttttgaaaatacccaatctgaccactaaaattattatcataaatcatataaatgtttttacttccatactcactacaagttaataaaaacccttttttttgagatactattttataagctttattctttttatcatattttagtaaaaacttctgatttaatgaatcattaaaactaaatgatacaagatcagtatcattttcatgacttaaaacattatttaaattattgcttgtttctattatatattcatcatcaggaataactgtttgatgtatatactcagcatataatccatctgattcaactctaaatttaaaatcctttgcttgtttcttagaaattttagtttcgtaatcataataatctaaatttgctttcacattaccagttatagtaaatgggttattgtcataaaatagaattatttgaatgctatcaactccatattttaaattatacgcttctaaaaatattgatatatctttaattctatttaatgcaataaaatcagctgaaccatatacattaccaatattatttattattcgtattccaataggcttactcaaataaacattatctagaaattaagagtaatgaacaggatttccattatatataggtcttaatttgacttcattatttcctacattaacaaatccaaattctctttataaattccaattattttttcaaaaattgtatataaaccatacaatttttacaattattttaaaaaaagtatgtagtttacattaagtgtttattatataataaatttgctataaataatagtaatatttaaatttattaaaaggtgggaacaatcttacgtgacagaatatattattaatgagaatttaattttagaagaattatgtaatggaaagataattttaagaaattttaatacaaataaaattcacttattaaacaaaacagcagcttatatactaaaaaatttagataaaagtacaagtgaattatctagactattatttgaaaacttatcaaacaatattaatataagtattttagaaattgaagaagatataaaattaacctttgaagattttataaataaaggattaataaaacctagtaatttagtaacaaagaataatttaaaatatgctaaagttagaaatttatatttagaaataatatcattatgtaataaacaatgtttatactgttataacaaagaaaatatttcaaagtatgaaattatcgatgtaaagaacatagaagaaataataaaacaatgtgatccaaaaattttagaaggaataatactatctggtggagaaccttttttatatgaaaatatagaagaaatatttatattatgcaaaaaatataatttgaaagttgctatggttagtaatggaagcttaattgataataaaaaagctaaaatgctaagtaaatataatattaatatccaatttactattgatggatataatgctgagataaataatttaacacgtggaaaaaattcatttgaaagtcaaataaacgctttagaattattaagaaaaaataattttaaaggatttttaaatattagaactaatttatggagtaaaaatttatcatataaaaatattaaaggtatagttgagatttgtgaaaagtttgaagtacttagactcgatttagttgaagctaaaaaaaatggtagttttaatgaaatattattagaatctgactataaaaaagtaaaatcaataattgataaacttaatacaaaagttaatattgtatatgaaagagatatagaagaatttaaatgtgaattagataaagatttgatgaatatagaatttgggttaagaatatcagctaatggagatgtttttccatgccaatattttttagataagcaattctctattgggaatatttatcacaacacattagaagatattatatatggagataaaaataaaaaaattatagatttaatatctcttagaaaatcttttataaaaaagtgtacagattgtgtttatggagataaatgtaatgctggatgtccagctaaagcatatttaaataataataatatattcactatagatggttcgtgttataagagaaaattagattttgctaattattatattaaattaatttaatatattaaataaaattaatagataaaaggagagtttattatgtacgaaaaaccaataattttaactgagcagcaagaaaaagattctaaaaaatatgtatgtggtacaccaggatgtagttgtgaacccgttatgaattctgatgaaagatattgccattttataggtgcatattattgttggtgtaaagaaggtcttaaatagactaattacttaatttagcaagaaactctctctatatagagggtttctttttttatttgggaggacatatgaaagagtatatattttttaatattaaaaagtttaaatacaaactactttataaaactttatataatattttaatatcaattttaggattattatcaattttaataacaaaaaatataattaattatgctttagataaagattttactaatttaaatatttcaataataatttttattagtttaacaattataatgttaattttatcacctattaattcatatatatcaactatacttaagttcaaaatttttgatgatatacaaagtaatctatataaaaaagtaataaatagcaagtttgaaaagataaataaatattcatctttagatattgtaaatagaataaatactgattgtggaacttttatttcattcatatatgaaataattccaacaacaataggattaatacttacaatagtattatcaatagttgcattaattaatataaattatatgtttttaataatacttcttatatcttcaattttaactactattttatcaagaatattaaatactaaacaaatagaactttataaagaaatacagaaaaatgatgttgatcatagggttactatggatgaatcattaaaaaatatagaatatataaaagtatcagaattagaagaaataaatattgattcacttaataaaatttacagtagaagaatgtatttaaataaaaaaatgtcaattgtagtaggcggaatttcatttttatttagtttaggttctattttatcttacactataatttttgtaataggagtatatcaattatttataggaaatttaagcattgctgagtttacagttttattacaaatatatagacaactaaattcatcagttttagaacttcaatcatacatacctagttttaataatgttttggctgctatagatagaatatatgaaattgaaatactagaaccagaagacttaaaaaataaacaaattagtgattttaaagaaaaaattcaatttaaaaatatatcttttgaatatgacgataataaaatattaagtgatttatcatttagtataaaaaaaggagatttttttggtataattggagaatcaggttcaggtaaaactacatttttaaaactaatggcatcacttttaacccctaaatctggtgaaattttaattgataataataaacttactaatattcatagaagtttaatttcatatgtatcacaagatgatatgctttttactaaaagtataaaggaaaatcttttatgtcataatagtcaagtaagtgactcagaattaactaaagttttatatttaactaaaatagattcttttctagataaattaccaaatggaatacacactaatataaaatacttatcaaaaggacaaaaacaaagaattgcattagcaagagcaattcttcaaaaaaagcctataattttattggatgaagtaactgcgtctttagatattgatactgaacaacatataataaattctattaaaaatttagattataaacctacatgctttatagtaactcatagaaattctatacttaatatatgcaataaaatatataatataaaaaataatgttttaacttcacaaatattaaattaaattttatatacttcaaaataaaaaagagtagtaaactttaagagaatgtcaataattttgtgtaaactatctaaaaaaatatattaaaatttattaaggtttagataatattttatttaaaccttaattttctttttatgtaattatattgaatataaattgtacaaaaactaaagctattatattaaattttttaatataaatggtcgtcaagacgttcgtcgaaataaattgaaagttgtgctaagatttgagaccatcccctaatagattgaacccatttttttgttatatctattgttacaagataaagtattttaagtaaagcttcatcagtaggaaaagctgttttcgttttagtaacttttcttaattgtctattatagccttccatagcattagttgtatatattattcttcgtatctccggtggatatttaaagaatgtagttagctcctcccaattgtttctccaagattttatagcaagtaaatatttatccccacatttctcctcaagataacttagagcttgaagtgcagcatcttcgtttacagccgtatatactagttttaaatcagcattaaactctttagtatctttatatgataaataacgactagaatttctaatttggtgaataatacaacgttgtacctcagtattcggatatacggcttttatagcttctttaaagccatttaatccatctatacaagctataagaatatctttaactccactgttttttaattcatttaaaacaagtaaccagtactttgaagattcagcagcaccaatccaaatacctaaaacatctttcttcccttcaatatttacaccgatagcagcgtaagcagccttattaactataaaattatcttttttaactttaaaatgaatagcatccataaaaacaataggatatatactttctaatggtctacattgccattcttttatagaaggtattattttatcagttatatttgaaattaaagtaggtgaaacatccatgccatacatttcattaacttgagtagctatatctcgtgtagacagccctttcgcatacatacctattattgaactttctagtctagatatatcagtttgatgtttctttacgatttggggttcgaaagaaccctcacgatctcttgggatatctaaatcaaataactccaaatcagatttaacagttttcttactttttccattgcgagaattagtagtatttttatttgtataatcatattttgaatatcctaaatattcttccatttcagcttcaagcatttgttgaattaaaccaccgaataaagttttaatagcattttgagcatcttcagcagtctttatattaggatttttggcaagttgttttattaattctttttcggaataagacatagtctgtgcaccctccttttgtatgatacttaattatatcattttagtagtttacacagactattttacactatcattttttgaattatatttttaaagagcagtttaattttcgggattttgagctgctctttttattattgataatatctacgatttgtttttaaaataaatataaatcttaatatctttggtaaaaataaaagcataaacattcctgttaaataagctattccactataatttccaacgatataataattgtgagcagcataaaaataatacactaacattatatatctaccaagcttaattattttcatatttgaaaaactaaatacacataaaactattaatactaaaataaaatccataatactcaatccccttttatttattattcatgtaaaattttatgaattactccaaagctacaattatttaaagctgcaagctcttttatcgtttttccttcttttctttgagctcttataatatttttttcttcttcagtaaatctaggttttctgcctgctccacgactattctttttagatttttctttaagctctaaatattctcgacttactctcattaaatccattctactatccacattaaatttcttataaattcctgataatatatcacgataatatttttcagtttctttatttttattttttaaactctcaatttctgataaaaatttattctgttcaaacgcactattattcaatagtttaactgtaaaataagtattatagccttcatttcttctttcatatatttgagatgttttttctattttaaaaagctttcttaattcattaattaatgtttcaacttcatcttttgagttagtttcaattctaaatttaaatccttcttggccataagtttgattatatgctttttctaattcttctcttgaatattctaaaacactaactgggtatgtattaactgtataatatgatttactagatttgctgtaatattcccttttaactggtatttcttttattgctccaattttatgaagttggtctattctttcagtattaacactataaaaatcagcaattgtccatgtaggaatgtatccaaacttttcaaatttattaaaaatagtatcaaattctccagctgaaactaatttatctataattttagatttagcttctctaggtttaaaatctattccatattcttcagcaagttttattatttcttgttttggagtgtccttattattcttaagttcatttagaaaaatttcttttaaattatccttcatatcatcaccctttatatttaatatgttaaatatattatatcataaattaattaatgaaaataccttttttcattaattaatttatgatataatcaaaatataaatataagtggggaggaaatggcagtatgatagtgattgataaatctttaggtgaaataaatcctgaaagttatttaataaaaaatgctaaagataatacatatcttttagcattacctaataaccttaatggatataattattttgaagtgtacatagataaactaaatagaagtattcatgtttttgatagtctagagaatagaaaaggtggaactagtgctattaatagtgtagatagaatattagaaattaggagacctttaaatttagatcttgactataagcttgtgatatattacccagatcatagtatatttaaagcttgcataacaacttatcatgaaagaaaaggatttaataaaaatagagactatgtaacatatataccttttcttaagaaagctgaattatttctaaaaaatagattttaaaagcttaaattaattaagatatttatagtataaaattttgtaattatgagaggagaataagtatggaaaatataatttttaaaaatcttgaagaattaaatttagaggaaaaactattacttattagaaaatatcatcaaataaatttatatacagtagataaatcttggtgtctacaattattccatttagaatttaccgcaaatgatgaagtagattgtatatgggaatcaagttctgaagatttaaataaacttcttaatgaagctttggaatatataaatgaaaatgagtattgtacaatctatgatatataatttaaatttttaattataaattaatgtaagtatagtatcatatatgtagatactatatttaattctaaataaggagtgataaaaatggtatatagaacattattaaacccacaaatagattttgtgtttaaaaagatatttggtactgaaaaaaataaacctatattaattaactttttaaatgcagtaataaaaccaacaactcccataaaagatgtagaaatcaaaaataacgatatagataaagattttatagaagataaattcagtagattagatgtaaaagctacaactagcaataaggaacatataaatattgaaatccaggtaaagaatgaatataacatgatacaaaggaccttatattactggagtaagatgtattcagaacaaatacaaaatagagataactacagtaagctagaaagaactgtctgtataaatatcttaaattttaaatacttaaaaaatgataaatatcataatgcatatagactaaaagaaataacttcaaatgaggagcttacagatcttcaagaaatacatttcattgaattacctaaatttaatgaaataggtaataaagagtatgttgaaaatgttgaaaaaatggatgctctagaaaaatggttagagttcttagttgaaccagaaagtaatactgtaaggcaactagaattaagtaatgaagaaattaaactagcaaaatctgaattatacaggcttagtatggatagtaaagaaagagaacagtataacatgagagaaaaggcaatatatgatagaatatcagctttagaaaatgctgaagctaaaggaaagatagaaagagagttagagttagtaaaggcatcattaaaccaaggattagaaatatcattaatttcaaaaataacgggattaagtaaagaagaaatattaaaaataaaaaaagatatttaataaaggaggaactagtatgaatataactataatctgtgctattataggtggattaatgggatacttctatatgaagaaaaagcttgagaaaaaaacaaataattagtaatatttttggaataactaaaaaagactctataatttagagtctttttgattttaattaaaatatttaaataagtaagattttatcttaatacctagcttgtacacccataatacatcctgtagatggtttaccccatcctgttactcttacaccttttccagttgttattccattatcacaatttgctattgcatcaacatatgttactccaccaataaatccagctattgctactacagctccagctgcaggatttattgttgcagctaatcctgctaatccaccaaatatagcagcatctcttttaaataagttattaattaattgagtaccttttttatttacatttgttttatatccccaccaataccattgataattagaacaataggaataactagatactatattcccatattctgaccaacttcttgttctagggacatcttctaagttttgatatgtatttactatttcattattttctactttaaatttaagagcattttgctctataaggctattaatttgatcagatccatctttaataaaatctactacatcattttcatattaattatatgctaaattatcgatagtaaaagttccatcaggattttgtattaaatatttttattctattccctttattactttaaacaaatcttcttcattaatttttttatcttcttttgtaatagtttgagcattaacggatttagcatctgaaaaacttaatgatcctaatgtaaaagttgaaaatattgttgctcctaaaatacaagaaataaattttttattcatgaaaaatccccctttataagttataatatatttaaatttaaaataacggcaaatttaacgttgaggtgaataaaatggattattctaaaataatttttactataacatatagttttataataattactcaattaaattttcttataagaattatttttaaactatatcctataaaaggatttttatttaatttgacagatgaatttattattgataaagatatacaaaatagaaaattaaatattgctataatattttcaatattgataattttagtgtctttatttttaataaaaactacattatcaaataatattaatagttcttactttttacttataatgtttataattgcatcaatgaacattataagatatcaactaaaaaaggtttaataattaatttaataatataattttaagttaacgtttacaatatattgtgcagaactggtcaaatttctaaccaaactggtcatttatattaaaatttttattatgaagggaaattttatgaaatataaagattttgatgttacaaataaaacatattgctttaagtttaatgaaacaaattgtagtaaatgtcatagcggaatatgtggtgttgaaaatagttcattaaatgaactatttaatttcaaagaaaaactacgttctaaaaatgatataaatagatgtaaaattatagctagtagattaattaataataatataccgtctaatgtgtatatatatttttataaacaatactttcattactcatttagtgatggacaacatagatcttgttgtgctgctaagcttaatttaaaagacaaaaaagtttttttaaaatcttatataagcatacaagattcattatgtccttattgttcattaaaaaataaaattgaaattttagaaaattattctgataacatatatataaattcaagagaattagaagatataaaaattaaattaaaaaaagattttaaattatggtcactataataaaaaaagtagctaagttttagctactttttttgtttttatattaaattatcaacgtttatattcatgaaaaatattcctttataagttataatataattaaatttatagttaaagaaaggatgatatttaatgctttatttaaatgttccatttgaagaaaaagatgaagtaaaagcgttatatgctaagtgggataacaatactaagaaatggtatgcaactaatcccaaatattattataaattttcaaaatggataaaaggaaacctagtattttcaaattctgtaataatagccgaaggaaaagttaagtgttggaaatgtcaaaatgaaattagcgtttacggatttgcagtagattcaaaaaacatatctgatataacttataataaaccagtagatatctcttatttaactggatttgatttacaaatatggccaatatctaatgaaaacatcccccaaaaaatacaaaatatacttaaagacaaatttaaatgtaaaataaaatattcaaaaactattaataaaaactatttagggaatacttgtccattttgtaattcacttcaaggagaatacttcttacatctggaaccagatagtccttttggtgaacttggcgattctaatttattactacacaaaataaaattaaaagaagacatagtatcatatttgagcatagatacatatgttgatcctccaatttctttttttaaaagaagttcccttattgaaactcaatatattatttaatctagaaattaaagtataataaataatatatttattatttatttaatactcatacaaaaaaggtaaaatattaatgatataaaaataataaattaagaggtactataatgataaataaaataaaatgttgttttgatgattttacatttcatgcaagagtaatgcctgtattggtagtttctattcctattattttaatgggaatttttaatggactacagtcaaaatcatttgctagtaatactatttatacattagttattatagcttttatttcttttgcttctagaatagcaagagaatttggtaaaaaagtacaagatagcatctataaaaaattaggtgcaatgccaacaacaataatattaagatatagcgataatagaataaatgatgtaactaaaacaatatatcataagaaattaaataaaattgtggatgaagttaatcttccagtagaccctaaagatgaaagtgaagattcagatgttcaatatgaagcagcaattaattggcttagaaattatgctaattcaagtcgtaaaaaagagaaactagtatatcaagagttaaaagaatataacttttggagaaatctttatgctatgaaatatattgctatagctatatatttttttataggattaagagaatattttttaaatgataattttaatctgaatgaaataatagccaagccttatcctcaatatattgcatttattattatgatatttagtattttaatatttatattttttttaagaaaatcaactgtagagaaaaaagcttttgattatgctaaaacattagtagaagtttgtgagagaatttaaaagtaatttttatattctatttttaatatttaaataatattttttatttcatattaaataattaagttttaggaggagatattatgctaaaattagaatcaaataataaaataacttttttcccagtaggaaatggagacactacattaatttcattaaaagataatacaaatatactaatggattgtaatattacaaaagattcaggagatgagaatgttattgaaagatatgatgtaataggatatttattagaaaaattacctagagataaatctaatataccacatttggatgtatttatactctctcatccagatatagatcactgtagaagtatagacaagcacttttatttaggaaatcctagtgaatatgataatgaatctgataaagataagataataattgatgagttatggtttgctccaggaatatttgaagaagatgaagaagatttaaatgaaaatgctaaagcatttaagaaagaagcaaatagacgaaaaaaactttatgaaaataacgatttagaaaaatctattattggtggtaatagacttagaatgataggttcaacagataatgaagaactggagaatataaagaatattacaacgtcagcaggagaatatttaaatctaattaacggaaagatacaagaagaagttagttttttcatattagggcctgttaaagcagaaaatgatgactcagaagttgaacgaaatcaacgttctataatattaaaaatagaatttaaaattaattctaaagatgttaataatgtggttattcttgctggtgatagtagaatagaaaattggaaaagaattatgaaaaaaaatgacttgaaaaatcttaaatttgatatatttatggctccacatcattgttcatggtatttcttttcaagtgaagattataagttagatcctccacccaaggctgatgaagacataataagctttattgagaacggtaaagaagatgaaaatgtaagagtaattatagcctcatgtaaagaaattaaaagaaatgaagataatccaccacactatagagcagcaaataattataaaaaagcagtaggagattctaatttttattgtttatctgaatatccttctgtagatgaacctaaaccattaacctttatatttactaagtttggtccaataaaaagtgaaatagaagaagtctcagaaataaactcaacaaaagcattaataaaaacagcatcaactccaaaaacatatggaaaataatctaaaagaaataactaatccatataatattaatgatgacttcactatgttttataaaggactactagagtgtaaaaatgttaaaaatattactatatataaattaaatattaactcagttataataagattagaattgaaaataaatttacctagtagaagaagtttaatggaatttgatataaaagaatttgaaccaataaaattattatgctctactaatgaaataaaatataaagctccacttgttttttcggatagaaatgatttcccggtagaaaagttgccccataccttagctatgggtctaaattattcttatatttgtttgcataggggaaatattgatgattggtatatagatcattccgtagaagattttgtaaatagaattagattttggtttagtgatgctgcatgtaataacttaataaaacctggagatgattttgaacctatgattaactatacggaaactggaaacattgtatattcttataataaacttactaaatttattgaagagtattggagtaataacaatgaaaaaaatggttttgcttatgcaatgtgttgttttaataataaagaagaatctgaacatcttaatataaacgaagaaagtttttctgttcaaatactagaagtgtttgagaaagaaaatttaactagtttattacaaaaattaaatagagaacgtattaaaaataaaaatgtttttttaggcatagtaggctggggacaaaagaattctaaatataatgaatattttaaattaataaatataactttagaagaattgtatgaatttaataaaaagataggtattgatttaaaaagagctttaaacattttaaaagataaaaagatacctaatattattgctttaatatctgcgataaatagaccgagtaaagttattggttttgaaaaaaatattgaatttataaattttttgtttaaaataaaaaaagttaatgagtttaatgtaaataaaattaaagaagatggtaaagctttagttgttaaacatttagaaccattaactagaaatttagctgctaatatatctactttatcctgtaaaaaaaatcctaaaatattatttgttggtgctggtgctttgggatcaaaaattatttttcatcttgctagaaatggatatactgatatatctgtagtagataatgatatattagttcctcataatcttgtaaggcatgcattattcgctgattctatttctaaaaataaagcaaaagagattattaataaacttaataatatatatattatggataagaataaaaattttaaatactattcagaatcatttattaattttgctataaatactgatctaagtatatatgatgtattaattgattgttctgcatcaaaatcagttttttcttttattagtgaatattctaagaaattaccagcattagttatcagggcagaacttgctaataaaggtaaactaggattagttttaaaggaaaatataaatagaaatttaaaaatagatgatatacaagtaagcttgtttaattatgcactttcaaataccgaagtagctgaatggttgaaaaattatcaaaaacttaaggagaattttgaaggagcacaatttgaggacataactattggaatgggttgtaatacaaatactatgaaaatttcagataatataatttcttatcatgctgctattttttcaagttatataaaaaaacatattacgaatgacattcaaaatggagaatttttaatttcttactttgatgagaataatctttctgaaaactattgtaaaattatttcagtacaagattttatttcagtaaatacttcagaaaataattggacaacgaaaatttatagaaaagcttatgaacgtatactaaatgagctaaataatagtaaaccgaatgaaacaggcggtatacttttaggaaatataaataaaaataataaaacaatttatgtaacagacatatatatacctaaagatagtaaatatggaccttatttatttactaagggaagttatggaaccaaagaatatttagagcatgttcttaagtctacaggtaatattattaattatgttggagattggcatactcatccagaaagctcaaccaatatgagttctaaagataaaaaatctttattagaattaaaagagtatttaaaagagtattcatatcctgctcatattatgatatttaatgaaaaagatattagttcatatgttataagttaaacataattttataatagaattcatttaaagtagtttatttgttgaattttttagttaaatatgacataaaaagagtagttcaaatttaactactctttttatttttgtattaacatatcttataatcctataataaaccaatatatgttctacaccatcctgttaatcttacacagtttctagttgttattctatatctcaattttctattacatcaacatatgttaccctaccaataccattaattgttaatttagctagttcatctatagatagtttgaacttttttagtgttaatacaagtacctaaaaatagcaatataaaaaaattatgaacaagaacctttttcaaataaaaaatgtatcaataaagtttatattatagtttataaaagttaacctttataaactttatttaatttatttatttttgtttttaaatgtatatagatttgtttttaaacgtttattaaaatctattgattttaataaacgttttttctatacttaaagtaataatttaaatatggagtgataaaaatgcgttataagttaacttatgtatatggtgactcagataaaaagtttactcaaacctttagcagtaaatttcttatggaaagttatattgaaacaggtaaggataaagatttacgggtaattaatatagaaagtagtaaactctatggctatgcaagggtaagctctaaagagcaaaatttagatagacaaatagaagcattaaaggattatggtgtaaatgaaagagacataataactgataagcaaagtggaaaagactttaatagagaaggatataaaacacttaaggagcaactattaagaagtggtgatgttttagttataaaagaactagatagactaggtagaaatatggcacaaattaaagaagaatggaatgatctgcaatcaaaagaaataaatatagttgttattgatacccctatattaaatactgaaggtaaaagtaatttagaaaaaattttaatatccaatatagtatttgaattattaagctatatggctgaaaaagagagagtaaagattaagcaaagacaagccgaaggtattgttaatgcaaaggctaagggaaaacatttaggtaggccaagagtagaatatccaggtaattttaaagaagtatatgacaaatggaaagctaaaaaaatcactggtgtaaaagctatggaactaatgaatttaaagaaaaattctttttataacttaataaaaaaatatgaaattgaaaaataagaaaattaaggtaattatatatgttttcaaataaaaagcttagaaacttatttagtaattggttaattccaataattttagcaattttacttgctgtaattatcaataaattattttatacaaaatagtagttcctagccaattaatgtccccaacattaaaagttgggaatcaactatttgttacgaaagtttataatacttcaaatataaagagaggagatattttactctttaattctgcaagaaaaaataaggttaatattttttattaaccttattttttcttgcagaatataaaacccaattaatattacttataataactaatattataagtaaaggaatccataaaaatttaggaatcattattaacataataaatcctataacccaaattattattgaatatatcaaatatctaagaaatagtttcaaataatcacctacttaaaattaaatttattattaatttaattaatctaaaaatcaacctttctaatattataatcttccttttgataaattaacataattctagataataattcttaaaaagtatctttatttaaaaaatgttaaaaatttgatataatagaattgtaaaaaaaattcaggggggaaaccaaatgaaaaaattaatagtaaaaagtacaatgatgcttttattttcttgcttattatgtttaggaatacagttacctaatacagttaaagcaaatgaagtgaataaataccaatctgtaatggtacagtatttagaagcttttaaaaattatgatattgatacgatagtagatatttctaaagatagtagagctgttactaaagaagaatataaaaacatgttaatggaatttaaatatgatcctaaccaaaaacttaaatcatatgaaataacaggttcaagaaaaattgataatggcgaaattttttctgtgaaaacagagtttttaaatggtgctatatacaatatggaatttacagtatcatatattgataataaattaatggtaagtaatatgaatagaatatcaatagtaaatgaaggtaaatgtattcctacaccaagtttcagaactcaagtttgtacatgggatgacgaattaagtcaatatattggagacgctgttagttttacacgttctagtaaatttcaatatagttctaatacgattacattaaactttagacaatatgcaacttctggatcaagatccttaaaggtaaaatacagtgtagtagaccattggatgtggggggatgacattagagcttctcaatgggtatatggtgaaaatccggattatgctagacagataaaattatatctaggttcaggagaaactttcaaaaattatagaattaaagtagaaaattatactccagcatcgattaaagtatttggtgagggttattgttattaaaaaaatgaggctacgcctcattttttcttttgatttttaatattttaataatataaaaacctagaatggatgatattattctaaaaattgttaaatcaaaattaaaagaataaaaatgtaacaatgaaataataacattaaataataaaaaaataattaaacttggttttagagaattatatttatttataacaataggtattaaaataccaaaaggtataaataataatagaataaataattgatctaatacaaatacattatctaataacggtttattactattaaataaattatataaaaatttaaaaggtaaatatgcaccttttgataaatagccaccaccattagtagtattggaaatacaaattaaaataaatatagtatatattcctagaaataaagatgataaaatcctagtatttattagatttgctttaagataagactctttagtagaatttataagttcatctatctgaagagtgttaattactttctcattagcttctttttcagaaaaaccttcatttaaaaaatcctttttcatttcttctgcggtatcaagtaactctaattttaattctgataattctctagatgaaatatctaatttccttaattttttatttaaaagtcttttcaatgtcatattttattcctccttaatattttctattaaattagatataagataaaagtctttaagttttaaatttaattcaattaaaccagcttcagtaattttataatattttctttttttctttgaactattagtttcaatgaaataatcttgtattaaatttttttcttttaatcttttaagtgctggatataaagttccttcccctaatattaaaacattctcagttatgtttttaatttctttagatatctcatatccatacatatctttattctttaataaagatagtaaaattatttctaatgaaccttttaatatctctctatccaaaaaatcaactccctttaagttaatttagtgttctataatttaattttacgaaaacatacattgctttacaaggtattaattaaaaaatatattatattttttaattaatttcaaaaaatacttaaagtattataatttatataaaaaagttaaagcaaaaagctttaacttttttatttctgagttataatgtgagtaaaaatattgagaggtgtattaagtatgaatttagttaaaacaagagatgatttagaaagagaagctcctagactaaaaaaagagtggatacaaaaaattgatagtatagataatgcaaatagaaaatatgtattagtttttgaggatctagtattcgaggcagacaatgaacaggatattacttcaagactaataagagattatatagaaactgatgatagaaatatgcagcttctatttagaattgactttgcaagagctttaagtatgtatagcataatgaatggaattaatgttgaagtttataataacgggaagaaagtaagagataactatgctgtatctgaagatgatccagattatgaaaaggactatgaaattcctgatgtaatcctggatgtatttgatgaatttactctttttaagggccttaatgaacttaagtatgctaaaatatactataaatctgatgatggagagtacaagctattttaatataaatttagaataaagaagtaactttaagtaataaaaagctacttcttttttataaggtgaacatatgaaaaaaagagaacaaatatatacatttttaataggattttataaaagaaaaaggatatcaacctacggttagagaaattgctcatgcagtaaatttaaagtcatcgtcttctgtttatagacatttagaaatgttagaaaaagatgggctcataatacttggaaaaagtgagcagagaggtagaaaaagaagtattcatattattgatttaaacaaaaagattaaaaaaaatgtatcagaagaaactattaaaaatttaattaaattttcaaaaaaacaagttaatactaataatgatatattttccaagaaagttactaatgattatatagtagctgtagataatatatttcctgatgacattattattgttgagaaagtaaattctctagaaaaggatagtataggattattattatttgaaaatcgtacctttataaaaaaaatattttcagattatgaaaaggtatatgatactgatcctatagttttagggaagattattggtgtttatagagattttttctgatattacttgaaaaaacataaaagaaacgttaaaataggttaacaatattaaaatttactgtaataatgtattagaaactttcaagtttatcagttaatagttaaaccagtattaactattaaattaattgcaaacttaatttaatctgtatatctattaacacaaaaagattatctctttaattttagagataatcttttttgtgtttagaattaaccaagaatattatacaatttaattatatcctatactcatagtaattataaattggggtgagaaaatttatgagattatcagaagaagataagaaatgtatcaaaattctttatagaaatggcttaaatgtaaaagaaattgaaaaattattaaataatgacttttctaaagatgctattcaaaaacatatatatagacatttaaaagaatttaggaatgaacatattataaatagagccttaaataaaaataaattaaagaaagaatttaaaaatattattaagaataatttttaataaaggactttccataattttcaagaatattatttatatattcttaaattagggggagttaagatatgaaaacagctcaagaagtagccaatgaattagatttaaccaggactgaagtttataatttgcttagaaaaaaaagattttctccattagttaaaaagaacggtggtcaagtagcgataagcaatgaacttttcaaattattagaagaagaaattaaaaataaaagaaataatattaaacaacaagagaataaaaatatagatataaaacaagaagataaattattagaagaaaaaaatactatagctgatgtgaaagctgaagaaaatactgattttacatcaactatagaaattctacaaaatcaaataaaattaaaagataatcaaataactattttaaataatgttataactaataacttaaaaaggataaaagatcttgaagaaaaaaatcatgaatttaaagagctacatgaagaagtcaataatctaagacttgttattgattcaatacaaactaaaaaaaagagaaaaagacttttaggagtattttaaaataagatagctaatatgaatttttatattagctatcttttcttaaaaattttaaagagttttaacactctatgtcattaacatttatattagatatattaggcaatgtatcatctgattttttttcagtatgttttttatttttatttttcacatttttaccttcagttatttcgctcaaactggtatcactaataaatcctttttctctttgcatctgaagataaagaagatctttaacaagcccaccaaaactggtgaattttctttcaatccaatcatttaattctttttctctaggatctttcaaattaaaatatacaggtcttggtattcttgacttttctttagccacttttaaacaccccacttagcaagcatgaaattataagctccaagtacatttgtaaacaatggatctttcattaaagaattttctccaaaatatttctctaatatttcatttcctaagtcttcagctccaccaccacttataacccaagtatataaatctatatctattttataaattttcaattcatttataagtctattaataagctgctctttctctttttcttcaatttttattctattattaagcaataaattttctacaacatttaagtcataatctttacctgccttttttaattctttcaacaaattattttttaagtcaagtattccaaagtttaatgtacatacgatatgttgtttaccatttataaatgttactacatttatagttcttccacctatatcaattattcctaaattagtatttgaatttcttatttcttctggaatagaaaaatatgttgcaaatccttcgccaattacacctaatttatttatttttatttttctatcctcatctttatatttaaatataaattctttatctaataattgctctttaaatttatctcttaaccctgaaacatgttctgcaggtgcccccatcattatttcaacttcattatcagatgttgctcttgaaatagctgctaataataatggtaaataattcttttcagttttattaaattcaaaatcataatttccctgctcaatacaatatttaataccatctatttctacaacttctgctgcagtataatcttgttgttcttcatttgtaaatctagcttggaatatatcacgttttattttatcacctgttttacatgctaactttgtatttcgattacctaaatcaatggctattttcataattaactctccttttcaaagaaaatatttaatattatttaatatcttttatgattaaataatatcacactaatctcccatagtcaataattaaataatattaattagtatcttttaatgttatttaatatcatttaacattaaataacctttcctcaaagccacaataccgacattaaataatattatttgatattatttaatattattcgattttcaaaacaaaataaaaagagagtaaaattttctataattttactctcttgaaaaattatttttaacatggtattattaactcaattaaattaaatagtacggaaaaggaaaaatccattaagttttcccaactcgccaaagtaagtaaacttaatggatgaacttaaatccgaaatagaacaaagttctatttgaaatattcacttttcatagctttatgatatcaaagctattgaaaaaagtcaatgatatctattgactttttaatagaaatgtaatattagcaaattttaacttctttctatttaggatttagtgtattttcctagatgaaaggagttatttttatggcacgcatacacttattaactaaagaacagttagaacaagagaaaaggtttaatctcgaagaaagagattttcatgtcttaaatcaaatcgaatataaagagtctagaagaaaagctcaaagtatcttaagatttatcagaaaaggtattttattaaataatggatcttggagcatctcattttctaaaattcataaagattataatgattgggtaaataaaaagaaaaagaaaagaccagaactaaaaaatataagcttaaaacaaataaaaaatatagtaaataaattaaaagatttaggtttacttattattgaaaatgtaaagaaaagaaactgttattttctgccattacccaataaattacccaataatgaaaacattacaatgcctgatacaacaagcatagaaggtaatcaagctactcctaggtatattaggaataataatatagatatagattctaatagtaactcaaaagaatttaatgcagacatgtatgaaaaatgtacaagtcttgttgatgttagaaataaagttaaagagttacttaaagctgcaagagttaagagctcttggattaagaataaggttttaacaaaattaagtgaaaactatagaaatataactgttaaatttttagagagttatattaatacagtcattgagaacactagaaatacatattattcaaattatagaaaatatatcaagaacaatgcgaacaacagagttctaccaaactttacagaaagaaattattcaaaagattactggaaatacctagaagaaaatctatgttttaattaacaatttaacaattaatagaatttattgttaaaaaatagattataaataaactgaaaaatttccagtttattaaaaattggaaattgccatattttttttatagataatttgatacaatgagaacagaagttcgtatgtatatgagaacaatcgtttgttttggttattgtcaacaaaataaaatgtttttatatagagcaatgatatttattgctctatataaaatataaatccttgagtatataacttaatattaaattttatgatttaaatagtatttaatttttcttccagatcttcaatatcgatattttctaagtcaagaatatcagttaaagatcctaaaactactccgattatattaatatcactatttttgtcataatattgtatttcatacggaagtgtactacatgggtgtagttctaatttatcttttttcttatgtatttttttacaagtagcttcattattttcacttaaagaagctattactatatcgccatcaataggagttttatttctgcagcaaataattaattcattgtctttgaataatttattcatactgttcccttttactcttaaggcgaaacaatctttgtaattgctaggtaaagcaattgatttactaatttcattaaatgcatatgatggggttccgcaagaaacttcaccaactacatctattggaatgaaatttaaattacttattaagtctttaagattacttgaaagaaaattttctttttcagtaattgaatagttaaaaatattatcttcattaacttctttgatagatttactatactcattttcaatagatttatttttgtctaaaagagaagcaaattctttagaaagtttttgaaaagttaaaatatcagattcactacgattagtaattctatttagttcaataaacattctttcagtacgttttttagacattaaaagttcatcaaacattctttcagtacgttttttagacattgaaagttcatcaaacattctttcagtacgttttttagacattgaaagttcatcaagcattctttcagtacgttttttagacattattaaatcttcatagtttttacggtttttatcaattagttcatttaagtaataaattttctctattagttcgttataggaaaacttttcttcagctgaattagaaattgctttagttgtaccaagtagttcgtcaatggagcaattcattacttctgacattttaaccagagtataaattggaggttcacttttagctctttcataataacttaaagtagatcttgctatttcaagctgtttagcaaaatcttcttgagaaattttattatcttttctgaaatcttttaatgttgtcgctaatctatgaagtcctatttccttagccataaatcatcctcccttctaaatatagttttatcagatgatttgataattatattgtaaaaagatataactaaaactgattttatatagttattttttaaatatttttaaaaaataaatgtttgttatgttgacattggtgagtgagcgtgataatatataggtaaattaaatgaaaatatggataaaggtgataaatatggaaaacaagttaagctttctaagaaagaataaagtgctttctcaacgagaagttgctagcttaattggtaaagaagcacgttttattcacaaattagaaaatgggaaagtaaaaaaccctagtgcaagtgaagtctataaattatctagaatatacgatacaagcatggaagaaatttatagagcaatagtattaaacaactaaataaatttaagttttgtccccactttaaaaaggagtcgaactatgcccttttttaatactcttttaggacatttttagggagttggtgatttgagaggaaagaatgagcttgataaaagtaaagttaaaagtctttacttagatggattttcagctaatgaaatagcaattagaatggattcaaatcgagaagccgtaaagaaatgtattcaaagaaatttttctgatttaagggaacacaacaaagctaaaagggaattgaaaaaactacaaaatgaagaaataaggaaaattactcatagagaatgtaaaaagtttatgagtgatagaaactttgttaagactaatagttccatttacaaacataatggacatggaaattttagtgttaaaaaagaagaagaaattggatgtgtagttccttttgatgttcctagacattttagttttaagaaaaagttttagacaacttggtacatatgcgagatatatttaaaaaatattatttcaaagggagagaattaaaatgaacaagagaattaaggccataatagaatttgtgaaagtacataaaaaagaaactataggagttgcagttgctttaggaatagtagtcgttggtgtaggtggatatgcaataagtaagcattatgcaaatactgatactaataatatagctttagctgagaagaaagaagatactaaaacagatgaagataaaaagctagaagaaaataaagcggtagataatgaagaagtaactgtagaagagcaagaagatggatcattaattgttaaagataaagatggtaataccattgccgatagctccaaaggagacgatgtttctaaaatagttgaagagaaaaaagaagctggaagcaatgttaatataaaaaataaaaaaggtgaagttgaaaaagtagagagtgttgataatggaagtataaaagtaaccagtggtgaaactataggttctaaaacagaaaataaagttcaagtttcacaacaaccaagtggtgagaaggttgagaaagtggaggatataaaaggcactactgcaagtagtgaaggaagtattacaattgtaaaacctagtaaggaagaaagctctagtaagcctgaaagtaacaaacaagagcaaactgaagagtcaaagcctgaagaagctccacaaccttctcaagaaccagaagaaaagccacaggaaaaacctgtagaaaagccacaagaaacaaaaccagttgaacctgcaaaacctcaaaaacctcaaagaacttgggaatatcaaagtggtatgagccaagagctttggaatgattttaatgcttatagacagtctcaagggttaaatgctttaaactggagtggtaaatatgctggatggacaaagagtcactgtgaagaaatggcacaaaagcaaagtggcttccataagagttatccggaaggtggtcaaatagtttatgatggaactgcatatacttcagctagttctattttaaatggatttaaaaattctccagctcataataagaatatgttagatccggatttaacagaaggagcttgtgcagtatataaagacagtaatggaagatattatacagttataggttttgactattaatttatatataaagatctagagttttactctaggtcttttttgatactgttttttagggggagaacatatgggaagagtgaggaaagatttttataaaggagaagtctataggggtgatattttctatgcagacttaggagacataaagagtaaggttggttcagtacaaggtggaattaggccagttattgtaattcaaaatgatattgggaataggtatggagaaacttttgtagtgacttctgtaacatctcaacctaagaaagaaatgcccgtacatactaaaataataaaagaatgtttagaaaagccatctactattttattagagcaaataacaactatttctaggtatcagatgagagagaaaataggaaagctaaatggatatgaaataaaagaactaaatagagcattaggaataagtattggtttaagttagaaagtttaagagtgttgcaattaagcagcactctttttaaatacaaatttttagaaaggagaaaagaaaatgaagtattttgatacatcttaaattaatttatcaaaataaaaaatgaataatatggaggagagaaatttgaggaaaagaaaaagatttagactaattacaacgataactttaatttttacatttttattgactaacatcaaagtatttgcagtagaaataaattctacagacgcagagagttatctaaattacaattctccaacttggggaaaggttcttcctataggtaatcatagatactatgctccagatctaaggacctgttattgtctaaatacaggtgcactgaatccaactggacaagattacacagaagaaataccagttgatggaggaatagaaactattatttattgggggtaccctgctaaagatggctcagaatgggggatatcagctgatgaatatagatattgtactcaacttgctatttgggcttatcaaaaagaagctggtttaagtaggggaattgatagaacaagacttcaaaatggaacagtatctttaagtagattaaaaccagtaatagactttttagtagaaaaaggattaaacaaagagttaccaacattctttgaagttactcctagtaatatagttgctcatcaagaaggtgattatttcgtttctgagcctataaaaataaaatctgactatgagtttaaagatgctaaggttactataaaaagttcaagtaatccaggattaaaagatatagttaagataaaagatatggatggagatgaaagaaatacctataattctaacgaaagttttagagtttatattcctatagacgcagaaacaggggatattaaggttgatgttaaagcaactgtagaattaccagcttctttagcttatgcaactccagtagcaggtaaacaagacatggcacttgttgatttaagataccaaaatatgaataaggataatgttactgtatcctggactggtttaaatggagctatagaacttgttaaaaaaggagacgatggatctcttttaactggtgctaaatttgttttgaaaaacaaagaaggcaatcaaatagctgaagctacatcagaaaatggtagagtagtattcaatgacattaagccaggagagtacatcatcgaagaagtcgaagctccacaaggatatttaattactaatccagttaatattactgtaaaacctaataaagtaactactgctgaaatggttgatactcaaataaaaggaagagtagaaataacaaaaattgatgaagaaactggtgaaccaatttcaggtgctgaatttgagatggtgaaggctgataataacgaagtagttgagaaaatgactacaggggaaaagggaaaggtattaagtgggttacatccttttggaaactacattgtaagagaaacaaaagccccaagtaaatatgtgcttaatggtaaagaatatccagttactattaatgaacatatgaaaacaatagaaattactcatgctaatagaaaaattaagggtagagtttcaatacacaaaatcgatgaagaaatgccagaacttagcttaaaaggtgctgtacttggtatttatgatgatgcaggtaatgaagttgatagattaacaactgacgaaaagggagctgcaacaagtaaatatctagattatggtcactacatcggtaaagagctacaagctccagaaggatataaattaagcgataaaactatagacataaacataactgaagatgataaagtttattcttatgactttactaacaaagttatgaaaggtcgcattcaaatagttaaagttgatagtgaaaacgaagaaaaaccagttgctaacgcaggttttaaagttgttgcagttaatgttaatggtatagaaccaggaactattgtagataaagttaaaactgatgaaaatggatttgcatttactaaggatcttagatatggagtgtacaaattcattgaagatgaaactccagaaggatattgggctagtgataaggaatacacaattaacataaatgaagataataaagtttatgttaaatacgttaaaaacgctcctatccaagctaagttaagggttgttaaagttgactctaaatacagtaaaccactagaaggagttaaattccaagttagaaatactgatactaataagcttgtagagtttacaaactttgtaggaataattcctcataaaacaactactttaacaactgataaaaatggagaaataataactcaacaacacttagcatacggaaattatcaattggaggaggcaaaacctaaggagggttatataagcataaagccaataccttttaaaatagacgaaaatgccgttctagaagatattaaggacttaggtactgtttatactattaaggtgtctaacgaccgtataacaggcgatatggagcttttaaagatagattcagaaacaaagaaacctttagctgatattgaatttaaagttacagctttagatggcttaatgaaaggacaaacttgggacttaaagagtaatgacaaaggaatagttagtttaaaaggtttagaatatggtcattacaaaatagaagaagttaaaacactttggaattacgttattaataaagagcctattttctttgatgttaaagaaaatggtcaaatagttaagcttgaaatggaaaataaaaagataagagctaatgcagaattaatcaaggtagattcagaaactaaaagaccacttgaaggggctgagtttgaactttggaatggtgaaaagtttgtaggaaattacacaactaacaaagatggaaaaatagtagtggaaaacttagaagcaggtaactattatttcaacgaaattaaagctccagatcattacgaaataaatcaagatcaagatttgagttttgtaatagataaagacggtgaaactaagactgtaactgcagaaaataaagttaaaactggagaagtagactttactaaaactgatgttacaaatggacaaaatattgaaggtgctaaaatagagatagtaggaatagaagaacaaaacaaacatgttaaatttgaatttacttcaagtttagctggcaataaattcactttaccagaaggtaaatatgagtttagagaaactcaacaaccggaaggatacgagctttctactgaagttggaacttttgaaattaaaggtggagaaattataaaggccaacttaaagaatgaaagaactacaggaaaacttatctttactaagacagatgttgctacaggagaagttcttgaaggagctaaaataaaaattgaatgtctttctggcttagataaaggaaaggttattgagtttatttcttcaaagaatggaaatgagtttgaattagcagctggagaatacaaaatctcagaaactcaagctccagaaggatatgagcttacaactgaaactggaacctttaaaataggtgaacatggtgaagtagttaagtgtaacttaactaacaagaaatttgaaattgttaaaacaggttcaagcttcgatgttaatgcattaattccatttggaattatattagtagcaggaggcttaggagcattaatactttcaaagaaaagaaaattatcataatttttttaattaagagagtgccataaggtactctcttaagtttacataagaaaataaggagatgagatgtatggttataactattattttaggattgattattataaatacttttatgtatatgagtttatttaaagtgtctaaaaaagccgatgaagaacttgaaatattatttaaaaaacataattttcaacaataaaagggagtgagaaaaatgagtgaaaccttattatgtgaaatagaaaaattagatttagaatttagttctttatcaaatagaaaattaaataaaaaggacctagaatacagaaaatatttaatttcaaaactacaaagattatcaaaagagtatataagatcttgtggaataagaaataaatataaacttgagaagatcctaagaaagtattactttgaatatcatataaaaacatattttaagttttttaatttcagtaacatagctgtttaaaaatgatttttattaatttttttactttcataggaattcttttaagtattttaggacttttttttcttatattaggtttggataattatattccgattgtggcaaggatgatgtttttagggatatttatattgggaatttttattataggcctttcttctcctttggtattaattagtgtaaagatactgatattagaaagtataggcttatttatattaaatatatttttaatattcatattttctaggtatgaagttaaaaagaagtttataaaagtatttttgatagctttaagagttttattaggtctgctaaatatatatttaattttttttagcttaataaatttaattaaagcttattttacagtgatagggtgtgtttaaaatgatgaaaaaagcctttataaccttaatcataattggaatattgttaataggagcagctttatttattgagtttaaatcaaagtcaatccaggatgatttagttcaaaaatacgaagaaaaaatgtatagtaattcttcagtaaattatagtattcctgaaacaactgaaaatacagagaaaaaagaagtaataaaagatacttttactcaacctaataacaataagaaaaatgaaaaaaatgatgtaattgggatattagaaatagatagtataggggttaaagctcctatagttttaggagaagaaaatctagattatgtagtggctaagtacaggtcaagttctgattttggagaattaggaaatgtaatattagctgcacacaataatatgcgtggatctatatttagaaaccttcataagcttaaaataggatctacagtaaaaataatatctgataataaggaacttgaatataaaataacaaaccgatatatcgtagagcctaatgacacaagcaaaataaatttttcaaatgacaagaaagaaataactttaataacttgtattaatcatgctaaacaaagattaattttaactggagaattagttaattttaacttggtacttaaaataaaataggaggaaataaatgtttatgaataagaatactagaaagataggcgaagttagaaagaaagttgaagcgataagagaagaactagaaaaggatgttctttttactgctaaaacacaggagtcaaaggagagaatta

SEQ ID NO: 29 - DNA, 100939 bp, Clostridium perfringens
ttctcctctattcttctgttcattggaagattatctaaatctttgtaacattaactttaggatttatcttaaatccatcattataaaacttccttgatttagagcctttcttagtttcatattctatttggaatacaccatttttgcaaaatctatttgttattttgttaattgtagatttatatttattagcataagttttatacatactatatttcatatgataataaaatttattaagtacactgacattattagcaagtctgtagtagttatataatcctctgatttgtgaattataaatatttaaaatttctaaatcatccatattaattaaatttgctctatggttttgtttccaagttccatctttagttattcttagtatttttaggtcttttaattttttaacccatacatcattcggaacataaagcttacaagtatatgaatgtgttctttttacaattccatcatcacattttttaatatcctgacttcttgaaactcttatatcgtatcctaaaaaccttgccggtttctccgtgttcgttattaaagttttttcatcagatagatttaatttaagttcttcagctaagaaatttcttaaatcatttttaatatttacagcatcctgcttactacctattactcctatcagaaaatcatcagcataccttgtatagaacattcttttatatgtttcatcatttacaattattgatggaatttcatttcgtttttttcttaattctgaaatttcaactttaagtctatttatatcatcattagatgcacttgctaatttttttcttcttctatttattttatttgtaatatttatatagtcattatttaactttctttttattcctttattaaacttttctgtgtacttttcaataaatttatctagtttatctaaataaatattagctagtaatggacttagtattccgccttgcggagttccgctataggttttatgatatacccactgctctaaataacccgctctaagaaacttccatataagtcttataaatttttcatcttttattttttcttttagaatttcaatcaacttatggtggtcaatgttatcaaaaaaactttctatatctccttcaacaaaccaccttgctccatcataatgacatttaatttgtttcagtgctgtatgacaacttctattttctctaaaaccatgagagttggttgaaaagctattttcatatatttcatttagtatcattcttattacttcttgaactaacttatcgtctattgatggtattcctaacggtcttttcttaccgtttttcttcggaatatatgtcctttttactggattaggaacatatttctcatcttttaatttttctattaacttttcaattcttttaatactcattccatctatggttttactatctataccttctgtcatgtttccttcctttgcatatatatttccatatgcttttagaaagaaattcacattgtatagatttctataaagtctgtcatatttataattggcatcttcacttttattttttagactttttaatacatattctggatttctcataagcctctcgctccttccttctatcgtattaaatatttaagctaccttccttcgccatgtaataggctttccctatctccgactactacgaaggttccgttaccatattgaatattcatatcccttgagaataatagccttaaataaggcatttcaacttaggtaatccccatttagtacgttgtaaatagcatattgtaatatcggatatgactttcgttctttatctttcactaagattacgtgatatctgagacactaaagaatatacggcatctatttatattcttcttgacatcatatgtcgttttatagctatcttccgacataagccacattatactcgttcgaactatcattcaagcagtctagcttttatccttatttacaatctttcatcttaccattcagtcgtatcttgataactagataactcatggtttttccaacatgctacactccccctttggtttccctctaggataagttggctgatgataggtttaattgtgtcttttacctaatattttgctaaaatataatttacaacacccttatgggcgcacaataccgatatgtccattcttagtataggtatcaaaaaagattaaatctcctcgtttcatttcagaagatttaactcctttacccatattaaccattgagaaagttacggcacttgctctatctcctagttgtattccagcacttgcatagcaataatgaacaaaagaactacaatcaaatcttcctgcgtctacatctgcttgtgttcttccaccaccccatacataaggtgatttaccaacccacttcataccagctgcgattgcagtttcgatagtttcattatcaccaacaattccaccaccagttagtccagcatttctaaattccatagcatatttaaacacattattaggataattattttgtgcagtatctaaatttacgttcattccatagctcggccctccattataacacgcaaatattcttcttaataattctctaaatgtaggatcattttcgtctgcgttccaatcaataagttccatattttcaacactattatagtttaatgtagggactattttctttcgccataaaacataatttgcatagtgtttagtttcataagcaccagttattatttgaagtcttatgtcttttaaaaacacttcccatatttcatctacagaactaaattcatatccaatagacctatataaatcacctaaacctaagtctaaataatatttataaatatcacttccatcaaagtcatatctttgttgttgcattactccataagctccatcacttgacgcaatatttctaaaattactttcttgtttagttatagcagccaaaacccagttaggtattccagttaatttagatgcttcttcatagtacggaataaactccattggtactcctaaagcacttaaatcagcattaatatttccattagaattagattttttagtttgaaaaataatcattgtaatactacctaataagagagtaaatataatgaagaagcttgtaccactaagaaaaaaatatttaaatatcttctttataaactgcttttcttgttccaaaatagcacctcctattcgagaaaaaaagtaataaaaaaagaaattagactaaataattagtctaatttcttaaatattttttattccatatggtactctattatcttccatttgccatcaataggaagtaattttattctataaaaaggtgtagtatttctacaaactggttgatttctattatcaaaattctctaattgaacataagttttaaactctaaataatcagtatcaagattaccttcttgttctgaagagtaaacttttttaggcttacttagattatatggattaagtccagccgtcttttttatatcctctagttcatatttgaaattttcttgaagtggtgtatccatatattgcattgcaatattagaatattctgttggattttctctgttaaaacttaatagagcttgtataaagttttcaactactctttttccttttaagacttcttcaacatcataattactctctttatttatgtaatttgcctgtttgaagtcctcaccttcttttaattgttctttagtttttattgatgttacaaatccttcaggaagtccatagtaatcatcttcttttaattgttctttcttattttctgtttttgcttcttcagtagtaccttctatttttgaggcttgtacattaggtttattatctactttatacttcttatacattataaaagagaatgatcctattgctaaaactccagttaatattaatgctattgttttctttttcattttaagctcctcctttgaataagtaatcttctttatcggatatctcaactttaaattttaaattcttatcactacttattgataatattgtttcaccagttcctaatagtggtattgcatcaacttcactttgagttaattgtcctaagaatattttatctaatacttccttagcattattatcttgttgcattatgaatttatactgagttaattcaaataatgtttttattttttttgcaacttcactattattaatatcaggaacaacatctctaatactttgagttgcaaatatatatccagcaaaatactttcttgcttctcttccaaatttctctaagaaatcaactcccattatattatcactattaataaacttatgtgcttcatctattaataaaacatatttaactgcctcatatattttcttttctctctcatcatatgcccttttttctttaagaccttgtattaaagaattattccaaagcatagtcaatacattaaacatttgagcattaaatattttactatccatacttgataaggttctaacttcaaaacttattaagttttcctttgttaaatccattattgaggaatgtccatcaaatattttaccatatgttactactaaattctctattgttgaggcaatatcttcaattctcttttgtctaaatctacttagatttttcttaacattgtcatcatcttcaaaataattatcttttatgtatttataaaattctgataatgttggatattcttcagctttatattcagtagctttttctctatctataccatagtctttataaaatgttactattaacttttcaaattctcttaattcatcatcttgtgaattaggtgctaataatttatacataatactaagtttagaaatatgttgcatataactttgttcaattagaacttcgttagtattttcatcaattatagttgcatatatgtgtaatggatttattattccactactaccatctaaagaaactattttccctcctaaatcaagaactaaacttctaaattcaccagctacatctaatattcttacggtgttaccgattatagtatggtttttaactaccttctttaaaagagttgatttaccagctcccattgttccaacaacaagtgaattgtatgattttcttgtttgagttttagcaaaaaggtctaatataatatttcctctaaccccattagttagtgttgttcccataaacataccataaggatcatttaattctacaaagttcaaaggataaccaccacctaaagtagcactaggtattggatgtccttttctcttatttcttaaatatttctgttctgtagagcttaaaaataatgatttccattcatattcttgttcattaagaagaactttccccctatatcctctcatttctatttcatcaagtacatacttgattttttcttccaattcttgttctgttctagcatttataaaatatcttatagtaattaattttatgatttcatctcttactgtcatatccataactaaattttgaagtgttgctacattattacttgcctcaataatatctatattactttttaaatcatacattctagtttgattttcagatatagatttatttatatcatttaaagcttttaatctatcttcagtttctatatctatagtagatataacatctttaatatctaaaagattatctagccaaaagtcattaacccagctaggaaaatcgtatattctaatacacgcctcgtagccatctccctttactatatttctattattaaatttaattcctccaactggttgtatcttatttaaaagatatggattaaactcttctttcttaaataacggcataaaattgtcctctctttctatttatttttaattttgagtaaaataaaaacacttagaatttaatctaagtgtctacttgaatgttcccgaaccaattttagctaaacgatctgcttcatcattccatttatcattactatgactttttacttttctaaaattattggtatttcttttgaatctcttaatttatctaatgctctttctataaaaatactttgcatagctaatatatgattaaaaaaattcatcccatttaggaataccatctttataattaatttcatcttcaaaaggatattttccttttataattagcatacactttctacaaatactaccattccaataaaagccaccaccataatctgtatatatttcaacaggttcttcacaatgttcacaagtattttcttcagatttatattttctccaattatctatcatttcatcataagtatcatataatttagggatacaaaaatccgaagtgccattatactcaaaatactttatacttccatcaattaatttaaccaacccattagcatgactcataaaaaatcctccaattaatctctattttcaagttcatttaaataatattcctttaattcctctagttctaaaatgaacttcttttctaaaataactctcatacttgaatttgtaacttctaatatatttttatgttcatctattaatgtttcaatcttttttaacataaacatctatctcctacttattaaaatcaagcttaaagtttacgtatttacccgtatcgtttaaaactacataagcatcatatgttccagttccatctttcttttttagtcctgtcattttcactttctttccagctaacaaactctttgctccagcttttgaaagtttcttacctttatctttgaagaatttatcttctttccacattgtaaattgacactttggatcatctttatatccttcacagtaaaaattattcttaccttcataaatattcttaccacaacgtggacatttccctataacttctctttctatttcaactttttcaataaaagtatctttactattattgaaaatttctctaagctcattagagaatatttctatagcagcatctatttttatttcatctttatatacttttttaagtatttttgagaactctactgtcttttctttatataggtctatatttagcttgtctaatatttctattagctttattcctttaggctctatagataaaactgatttattttcacttatatactcatactttttagcattttcaataatccctgttctagtagcctcagttccgatttcaagaccttctaaaattgccttatagtcttcttcttcatcatctgtaaattcattcttaaatggatttttaagataattactcagcatttctgtagtcatcttagctggtgctttagttaccttctcaacggctttaaagtaggtatttactttatctccaatattaagattaggtaatgtatcttcttcctttttcataggctcatattctaagaatcctttttgaactacaacatcaccttttaatgaaaattctaaatctccaacttctatttttattattgttctatctaataaagtttcttcaactaagaaattagatataaacctatttttaatagtattataaacctctaacatcttgccctttaattcatcttctttaggtatttttacagtaggggtaatggcactatggctctctatcttagtatcatcaaagatactttttttatctttaaattctaagatgtaaccttcagcatttaacttttctataatgcttttgacttttcctttttctgcctcggctaaatactccgtattagttctcggataagttataaaaccttgttcataaagcttttgaataaagtctaaactctctttaaaagtcattttatactttttacttaaaagactttgtaatttactcaaagaaaaaagcttactaggttgtttctttactctcttagtttctttgtctaagactttaccttcgtaagcatttaattcatctgcaaagctcctcgctttatctaattcatttttattaaaagttaattcttttatagataacttaatcacttctccattagtcttttcagcactttcaacttgataatatgtttcaggaataaagtttttaatactcatatctctgtcatataatgctttaactataggcactaaaactctacctactggcaattttgattggctctttaatataatatgtctacttaaatttataccgactagccagtctaaatatgttcttaaatagccttcattggctagattatcatagttatctatactctttaaatttcttaatcctaataatatggattgagaagtttgttcaggtagccataatctagttactttcttattaatattgttattatcaaaaacattgtttattataagtctaataataacttctccttcacgatctgcatcaccacaagatactatttcatctactctatcacttttaattagattttctagtattttaaattgtttttttactccactatcatcttttaatgtaaatttaaactcttcaggaataaaaggaagtatatcactctcccacttgctacctttctcttttcctaagtattcctcaatctcatataatctaaataaatgaccaaaagcaaaacttataatatagttttcactttcaaaatatccatcatgtttttcaaaattctcacttgtatttaatgcttgaactatgttcattgctaaacttggcttttctgctattactaactttttcatatattttctacctcatttctaaatgatataatttaaataaaaatttaaaaggatgtgtttttttgtttaattttataaaagattttacacttaaaataattgagaaatttaactttacttttaataataactcgactactataatttataattttcctaacaatactaatataaatacaaaaaattattcttcgattagtaaaagaaatcgtatattaatactgttatttataaatattatctatattttagtattttgttcttccttttacttgataaaaaatccatttattaaagcatcttttttgaaaatattccctgaaccatttcctgaaattcatgttaatttttttcatttaataggatatattctattgtttataagtttaatctcttttaataaaaaaatattaactagaaatttttataagtctaatctaataaagtttataataaagtatctaatttcaatatttatattactaagtatatttagtaatattttcgtagttattatttataggattttaaaattcctctttataacagcttctcttttaaataaatcaatagaatatttattgccataaatatcgctgctatacttcctatttttaaagaatatttatagaaaaacatattgtaaaatataaagaaaatacttaggctatacaaatttactgctatatagtctaagtattttttcaaatcttttttactttgaaattgactcaacagaaaataatacatacttaggaaaatcaatgaaattattattgaatatacactcatttttatattagttaatattgatatatcattcatcttttcatccaagcttaatattaatactaatatagtgtttataaatattactaaataaaatataaacttttttatcattactctatacctcatttctaaaattattattttacacttcacaatagaaagttaaaaatacattccataaaatacatatccatgccttatatcctacaaataaactatatttataaaaaaatatattatataaaataaaaaagatacttaaactatagaaatttaatcctacaaatttaaagtatctttttaaatctatttttaaatctttaatgtaacttataagacaaaacataattgataagagtacaattaccaatactattaaaattaaactacattttatattgttataaatagatactgtctgatttacttctcctaagcttagtagtaatgcgaataatgtattaatgaatattcctaaatagaatatatactttttaggcattaatctctcccattccttttcttgtttttccaatggctatagcaaacttttcaagctttccaactactctattattatcatctaaatccagtacctcattattgttatttactactatattggtataattataatcttttctaaattctactatacaaacataatacatatctccattatctatatttttaattttttctattctttttgttaccatcttagatcacttccttttttatgttttaataagctttgaaataaagtctaattaaatcttctctttgtttttcttcaggaactccatagttataaaactttatatgctgatattcccataagctttttggaagtttaaaaatattatattttcctttcccaatgtcctttaaatatccatatctaaaccactctattttatttaataaatattgtttttcacattctcttatatctaattcttctattctatgtgttgtcaaagcttctatgtaagaattaatcaaataatcttgctccataaaatcattaactagctttaaacaatctttaaatgtgtttattttatcaagtctatcttccacctcattatactttaaatttgctcttttccaaaaatattgatatttcatttccttagtcatctcaatcaactcctaactttaacctttcataattataaaaacaactccaaaatatatcacaaatttaagaataagtgcctttaatgcctcaaattctctatatttaataaaatatattagctctatgaatagtagacaaaaaaggatatatatatgctcataaaatttatgtgtatactccatatacttcattaattgttctactgaattacttgctaatataaaccctaaaatatataaacacataacaaatatatatacacctaataagctaaaagaaatcttttctaactttttagctacttttttattttctaccatttttaaagaagatatttcaataataaaaaaagttgctacccaaactgtagcaacatctaatttaaaaactttcatttaatttttctcctatttccaatatattttataacaataataaaactaagaaacttattacaatatatatacaacttctaacaataagccatattatgtttttccaattcttatacttaattgataagattaactccataactaaaaatcctaacaatataaagcctgaatattcaaaatgtctaaataacatggctaaaaaatttggaattaatgatgtgaaatatataaaattaactacctttatattgagtttttctttaaaatactttaaaaacataccattttcaaccattaaaaataaagaataataaatacttaaaagatcacttctaattataaaattctcaataatattcattttatacgctccatttacattaacttggtattcatattattaagtttgaatagtatctttattttcttctctaaatctaattgtcttaatggaactgctatgttttgaacaagctctactttctttgtcatattatctttctcatttttatttttcataaataccataaggaaaaactctttgttatttctatgtttctccataaatcttaatttctccaactcttcttctaagtagttgataaatatttcatctttacaatctgcaattctgccttctatatactcttgttgctttacagtatttactggaaagttcattataattattttgaaatcttctacaaagtttcttaaaaaagctataaaactatacacatatacctttctttcatcttctgataagttactggtatctctagtatttatttgataaatatctaaatagccttgcttagttataaatacatcatcttcatctatatctataaatggaagaacttttctagttgaaggtaatgtgtttttactttccttttttagctctttttgttcctggcgtttttcttttttctcttgctttaattttaacttttcttcttttgaaagtttaactttttgctctttcttaacgacttctatatccttaatttttttatttttcatactatcacctcattaaaataaaccaccacataaattatgtggtggttctatattattctgctatataagtagttttatctctcattaaagctagataaacactttgataaactctctttttagggttaaccatacttttattaactaaataaatagttgatatagccataaagatataaaatggtattaaaagtggtggatatactaaactttgcaatgaaaaagctatcatcaaagaaagtaaagtcattgctaaatcaaagaagtaaaatctactactaagtttagtttctgaagatatttcttttggtatattatacattactccttatctcctttcttattgtttttcttttctgtaaatcttctaggtatgttgtatctttgagtagcactcttacctagtctataagcatctccatattgattaactttccttgttattggattatctcttaatatatctctgccttgattttctatattttcaggttgatttactccaagattattattgatattgctattcacattaggaatattttctttattacctttcatttcatcttgtaaagttgaatttcctaagttagaagttggagcttttaaatctttgtccatatttccattagctttattcatctcactttgtaagctctcattttgattatttccatttaatgattgagccattggattattctttttcatttcttcttgtagactttcacctttattgttagctccattaattccattaactttattcatttcatcttgtaatgtttcagaaggtttattactttctccaacttgccctttaacatctttcatttcttcagataaagttttattgttttctgttgaagttcctgtattatcttgattagttttaaaattagcttgttgctctgctgaatttttattagtattttcattttgagaattatttttcattgtagaacttcctgtactttcaccattaacctttttcatctcttcctgtaaggtcattccattagaattattattgttttgttgatttctaacttcttcttgctcttgagctaaagtcttattaccactagctcctccaaataatcctgaaacaccaccagcaagaccaactccaccttgcataactttatctaatcctttaactgctccagctcccatcttagcagcggctttaccaacaccaaaaatactcttagcaccagcatatgctcccatcatagtattaaatccactctttaatccagcgtctatacctagtattctctcaactaaattaggagcatctattactgcaaatgaaacacttatttggaaaataagttttgctagtgttcctgatgtaaaaccaatacctatatcagttgaggttacaactgtagataaccaagcattaaataatacataaagctttaataatattgcagttaacattattattatgaaacttgctaaaatatcttttaaaatagctttaagccttttattatcatcttcaatatctgcaaaggcaaatattattgcaaaaagctttttaaaagctaactcatatattagtttagcaactttaaaaccaacacatagaagagttataccagtagttaaaagagaaattatgactggaataaaatctatattatatctatagtaattttcatccattgctatccagtttttctctaatttaacctcatcaggtttaccacttggtaacatttctatcttattcttaaatatataatcatttttagtttcactatcaatcttaaaatcctcattaatatgaatattaaatatatttgaatcaggtatattatttttctttgagaaatcaaagtcattacgatctaaagcatataaatcatataaagcatctttaactagaagattagccgagcttgtatattctgattttgtatcccttactaacatatcggttatcttattcatttgaaccatcatcattggtagtgccattactactattaaggaaaatagtatatttgttggtatgctctgcctatctcttttcttattgagcattattttataacctaaaatcaataaggatattgcaaatattgcccacattataggcttatatctatctattagactatttatttccttactctgaaaaaaattatttaaggtatatatcttatttactgcttcttcaattccattgactacactagctaatacttctattgctccccatcctagccatctaaaacaatgattaaccactccagttatagttaatatacctaaattggttagttctaataaactcattctaaatcaccacctcattctctttttcttctaacttatcttttaaaaatctaattttttcttctgctattggtatttctgactttataagtgtttcttctatttctgataaaatcgtattttcatctatccttttcaaatttaatgcagctaattcttttcgatacctcataaggctcattgaaaatgttgaaatatcctctcttcctaaaaactctcccaactttatatttttatttgttacttgattatcacctttattttctttttcttcatataatgagtttaatctttttatataatcttcttcactttcctcaaagtttataagcaagtcatcaagatttacatttctatgtttagattttattcttacttttctaaaggctttttcattatcaaagctttctcctagatactcccatctaaacttcattgcggtttcatcatgattatatattggatatggaactattctttttctatttaagtcttgtctttttataacccttataactaccatttctccttctttaaatgcttttaaatcagatggaaggagcaatcttttactatctaaactttctgttctatttttagtaatatctaaagtttcccctgacctagactcggttactatagtttcctcgcctaaagcctttgatacttcttctgccgtatcattatcattagttagaatgtagattaagttaccacagttacctattatggttttatcatcttctccataaagctttttaagttgtgataaggcttgtattacaatattgaatcttattcccctacctagacaaacagtaactatatttgcaaatccttctatagctggcatattaccaaactcatctaagttaaaaataacctctctttcacatttaccagtttcagataatgaggcttcttttgctaaaacataataaagttgtcttataaaaatactagataatacatggtttgaaccatcataatcaggagtaactaaaaatagtgcaacaggcttattctcataagtatcatctgctacactatatataagttcatattctccaacttcatcaatatctatatctatgctatcaacttcaatctttgattttatttcttttcctttatatccaaaggcttttacaccttttaggaacatttcatctttaaactcaaaaccttgttttatttcaatatcaccaattccagtaaagtagttttttgtttctgtattttctattggtcttattataatgtctttatcagcttctagtctttcttttactaatactcttacggtcttagtaactctcttattaaatcctacatctctaagatctatactatttttagatgtcattctagcaacactattcattgtaaatcttgaaagctcagccatagcaacggcgaatatacttcccctagcactcccatctgcgaatttacttgtagcatattgcattttagcaactgaattagctggtaggttttgaaagaaattatctaaagcatttactgtttcagtcttttcctttccatcctttccaactactgatacttgtatatcttttcctccaagttcagaaagcatattagcaactgtatatagagttatttttgagttttctttttccttctctttttctaataactctatcattctttcatttttctttatagtttctaaattctgctctttattttcacttgatagctctgtatttttcttttcatagtttaaaatctcattatctattattttgcactttttatcacattcatctataacagctagtataagaccattaactaaactcatggctgagttttgccaaaatgggtctttagctgatggattatagtataacgagtaggttaatgttttacataaactttgagcctcgtctgtatctccattatgatatgcgtcaattattaattgtaatggattataagatagagattttaaaggatttagtaagtttaaacattcaactctataaccacgcttttcaagagtttctttagacattgctacaagctctccctttggatcattgattattagtgaggcttgaaattctgcccttgaatatatgtcatttatagggactactatcatttcacctttaccacttcttgttgttcctattattgcattattaacaggacttgtatcaatataaatcttatctttataccttgatactggaacgccacccccacctttatagaactcatctttttcaggaatcgccttatattgttcttgtatttcttctaaagttgtaaaacgacttttccctttttgacctaagtttaaggtttcaaatgattttttcaagtcgaatataagctttgtagctggtatagttattactatgtatcctataagataaactaaaggatatttaaacatatattttaaattaaaaatacttgttaatatgttaaatgtttcagttccttgtccacttgtaaaggcatttatagtattgaaagttgaatctattgcactaaaaaaaacatttaatattacagttgctaaagcaaacataaataatattaatcctgttaaagttttattatttgaaataaattcttttagattaaacttttcagatttcttattttcactcttttttaaatcttccataactttagattttattttttcaaaaatcttaataatcatatattaaagactaggtattataatacctagccttttcctcctttctttctacatagacattccttttgacttattgttatccttctctaactcaatacttctgtctactttttctatatttaattcattatcttgtgcaaattctaaaagctctttgtaattccacttttctatttcattctctaactcttttctatttgcttcttcctcattcttatctagggatactggagttaaataatcaattgcataatcttcaaattctttaatactttttatttcttgaccttcatctaaagaatctttatgcctaatttcaacaccttcacttaaatactctgcaaatatagcatttaaattatcatttagattaactttatttattgatatatcatagttgaagtttttatctatacctaaatctactaaaatgtctattcttctatttattttttcttctaagttctctgcaacaactttgcttactgaattttctcctattaatgagtatatatcttcattaatagctttcttttcaatagaatctatagcgtcataatactcataaatgtctttttcaaaaattcctaaagacttttcttttataagatgtgaaaagacttctctatcttcacttgctagatcattcattgacttatctttaattacatttaattgctcttctgaaatattaactaaagaactattgacattcttcaaagcattttcaggatgttcaatacctaaaaggttataatcttccttagataagttaactactttacctatttcatacttatactctaatccaagcatttcatcacaagatataggttcttttaatcctataaactctgaaaaatctttccttgcactttcttcagtacaatcccaaataaaaggattatttttatcttgattttcttctgccctttgagttctccattcatcatacttttgatgtaactcattatcactatatttcttttcagaagtattatataaatattggttattgaatacttcaatttcttttccatttagctctttgattttagttaaatcaaccattttagataattcaaactcatcaaaataatatccattacctatatcatttttataagaattatttttattgccttcaaaatgaacttcaaatttatcatttttaaatccttcaacaaaaaaagatgttcctttctctatgaaagaaccatctatgttcaaatctttgtttaaaatatattcttttctagctatatcattttttaaaaggaaattgtttaaatcatcatataatattaattcaccaatcatattgagcttatcactttcaagtcttttattgattttttcttgttcttcttttggtaaatcataaaattcttctctctcctcaggtgtaatcccaatacctaaagttatagactctatatcaccttttaaaacatcaattttattttctaaaccaccaatcattactaattcactattagtaaaatcagctttatttagctcattatttttttctttatccttaatcatttctgatgttttttccacttttagcttagcactttcaagtatttctttgaatttttctatatatttatctaaatgttcaattattttttctaaaattgttttatctagtatctgattattataagaatttagctcctcatctatgtcattttcatcattcatcatagcttttatcttctcgattgctatctctttttttacttcgtcaactatattatcatttaaatactctttaaactccatcacagtatagtttctctcttctgctaccccataatataagctaaatacattcagatcatttgcaacttcttgtattcctttaagttctatttcttttttaatcttttcaatatcaaattccttattaaaataaggtctaatatcagtagttgcagtttctaatttgctaacttcttccactaatgcatttataagttgttcttcatctatgtcattcatcatagcttttactttctcaatttctatctctttttttacttcatcaacgaacttatcatttaaatactctttaaactccataacagtatagtttctctcttcttctacaccataatataaagcaaacacattcaaatcatttgcaacttcttgtattcctttaagctctacttcttttttaatcttctcaatatcaaattccttattaaagtaaggtctaatatcagtagttgcagtttctagtttactaacatttttcactaattcatttatcagttgttcattatcaatattaatattatttacataaactccattgaaactcatattattattattattattatttcctatagctatattaccatttatattaccattactattttcaattgttatttttgatgaattatttataatattattattgatttttatattatttgttgtattattcttaaaatctgccataaaaatccttcctttcaactacataaaataatttttctatgctaatttacctctaaaaatacatctattgatatgacttataattatcatctcattattagctctaaagctatttaaatctaagtctaagccacctgatacatatgaattagtaacatcattatctgaagaaatataaattaaattcccacaattatttaatatagttttatagatttcaccatatactttttcaagttgtggtaaagacttaattgtgatattaaacttaattccccttgctaaacataatgaaacaatattatcaaagttctctatttcataaatgctctcaaaattatctaaattaaaaataacttctcttttacatctttcagttccagctcttgaggcttcttttgctaaaacataataaagttgctttataaatatattagataattcttcaaaattaggagttgttaaaaatactgctactggtttatcaccaaagccaatatcttttaaaccaatagaattattagctattatttcagaaataactccatctctaaatttctttaacttatctattgtaattaaaaatatttgtttctttaaccttatgtttaaatattgtattcttttatattcaagtcttccaattgatggatacttcatattttcaaaatactgatctagtttatttttcccttgttcatcttgtgaaagacctaaattctcaataagttctattacatcctttaaattgaatagtccatcattattttctaacataactaatataactgaattaactaaagtcattgaaattgaataccaaaattgatcttttcttgacgaatcataacatatactatttgttaattgcctacacaactttaaagcctcattggtatcaccgttattatatgtgtcaattattaattgtaatggattatatgaactagattttgaaggtatctcactattaatacactcaactttatacccattctcttctaaaatatctttataattttcaaataactttcctgtaggatcatgtgttacaaatgatgatttattttcatctgaatataaatctattagatttaatttttcagttcctaacccatctgaactaataattaaattatttgaatttctaattaccttaaataaattttctttattttttattcttttcataaaaaactctcctttcaaatttataaaaataaagccctcaaaatgaggactttattttaaaatgttattttattttgtaaagtttgggctattgcagtacatcctaagcatactactaaaccaaccgcagcaccaatataccacggtcttgcttttcttcctccttctgcaccacctgtcatttgcaaaatacccccaactaaaaaagctatagcagctaatggtaaagcagccatttgcccccacttaactatttcatataaaaattgtattgtactagttactgcatccactataaagtcctccatttattctgtaattttttataaataaaaaaacgctagaataatttctaacgcttttattaactaacttctttatcattgacaaattctttcctaagctctaagccttcgtttataatatctaaattttcaaatataagctttttatgagcttcatctaaccactcatcataagatatgcctttttcagctaaaatcttacttgcagtatctttaatgctattacttggcttttgtctattgtttcctctaatagccatgttcctcacctcccttcaagtaaataattacaataaaaaagatatccactagggacacctttataaatacttagttatatatatttcatacaaaataaacatatatattgcatttcttatactaaaatataatgctcttttccattctttttttattaataatattatcaatgaatttaacattaataaccaaaatacataaataaatatatgacttcctgtccaataactatagattgaagaacatatagatattgaaaatgaagttttgattataatattaaattttttctcatcaatattatttttcaaataaatacataaaattgttccctcaaatataaaaagtaaatttaatatgcttattattaaattcatattatatatattcatatgttctataaactgctaattttcacttaataatataaaaattaaaaatgttccttatggacacctttataaattacttatacattccagttaaaaacttcaaagtttatattattattttcttgcatatttagatggctaaattcatcttcttttttctcaaaatattcatagtaatcattaagattttgtagaaataattcaaaatatttgttatctatatttcctaaaattaaactaatatcatttagtttaaaatcttctaatctatctaaaattatttttataattatatgctctaaaactatatttagaaattcctcataatgataattcttatttccatatactatagctaaagctacaggctttttaacataatctttataaagcaaagatttatatatattctctaaattatcatctacaatattttttatatcatcaaataatgggaaatcaatttctaatggaacactatgaatctgatatattataattcttaaaactctaatgaacacagcttcctcaacgccctcaatatatgaggttagatattctttaaagtcatttctattggctaaaaattttctttccattttaatatttgttttttctgtattatctaaagttttttcaatgtatctatataaaacttttgatacataatcaataacttcactattaaattcttctaaataatttactaacatatttcttgtccaagaaatacataaacatttagcaagttccttgtctttttccatgatgttagaaataaattttaaatcattatactcaataatatttattaccttaacatcatatcttttttcttctagtttatttcctatcatttcaccttttggatcacaaactattactgaatctttttcactatctaaacttgaaattctctcaaataatgctttatttaaaatttcatatgcttctcccatagtagttctcataaaaaatcctccttaaaatttctatttaattttatgtgtcctatgacacaagaaatatttgcaaaaaaataaaagcatactaatacgcttttctatttcttaaaatatttataatttttagatattatttctctatgaattgaatacataataaaataataatcaggtctattatgaaattttaatttatactttccagctttaaactctgtaggcttaaatccttctttaaaagttccaaataaattggtagtttgtctacacataacattagtagcatcaaatgctcctcttaattcattaatacgagctatttcactatagaaatcaacttttgaagcttttctccatttctcataaaaaagtagtagaataccagttctaaaataactataaatcttagtcttttcatctattaaagaactaagaataacatcaatctcatcaagtagattaaaatcaccatttacataattatattctgcataaaatttctctagttcacttaatttcaacaccataactttctctcctaactcttccataatacgaatagtttaaatccttttaaacttaattatttcaacactttacaagcattttattctcaaatattaaatcactatctaactcattcataaatactccttctcaattctatttaaaattattaatatcctaaataaaggaggtgtatcagatgatggctaagttaaagatttttattaataaaattctttctataacttttgaatttaaaaaggttgtactcggcttattatacataggctgcttagtattgcctttttcaattcttagtggtgaattgccattagtattctatgttgcatggctaatagttactgtactatttaccttacaacaaggctacttatacggtgtgccattaaaaaatccttataaaaaataagtttccgacgcttatttttttaatcccaacattatttgttgggatttttaattttcttttattcttatacttagccatcatctgatacacctcaatttatgagatttttattttttcaaataaaaaaagaatactaatatgtattcttccttgtataacttcttttaattttttccttaatctctttttctactctaagacttacttctaaatcatctaaaacattattaggtacatctatcttcattgctacttgatttttattactttgctttttcttattcttacttgttttagatgttaatggatttttaagtctttctcttgtttttgaatattttctatttttattttttagctgatccttttctttcttccatgtactagggttctttttatctacatagattttttctttcttctttttaggttgaaaacaacttctaagtattatttttttactaaattcatactctccaagctctatgttgtatgttattagtcttttctttataagttctttattattttgaacaaactcccaagactccataaaaacaccctttcaaactaattattttttaattttcttactttcattatagcgaaaattattactgataaattaatggtactatagtaaacattgaaataattccactatctttaagtttatttctatacatttctgattttactactgaacttgaaatagcctcgtttactttaattgcatattctccattaatttcattaggtagctcattctcactttgagaatgattaaaatttccttgataatatggacttgctggatttaattgactatatggacttaatggatttaaaggatttaataaatcacataaataacattcttcatcataaccttattatataatttctttatttctctctttaatccttttaaccagctattatctatccatatcttttttaatacataactaaaaaaagataatactatcattaagctccatatattagcaaaaagattattatctgtcccagcaatttctattaatcctatggttgctagagttcctataactaacaataatattatatctaataaccttattatccctttctctatcttatatcttattgaataacttccaactatcttaggaaatttaataaaaatataaattggtataaacaatattgtataaaattcaaatatattaataaacattcccatacctaatttcctccaagctctaaagatgtaaactcatatccttttatatcttcctttggtagtaaaactaatccatcatcttctctatttacaatacaatccaaatctgtttttaaaaatatattgaaaatactctcacaatcatattctttattactataagcaactatttgtgtttccgtatcatctctcattattatattcaacacatacttatatctcttattttctaaatttcttatagtttctgttcttttttcttcttttaaacgcttatattcttcacttactatatatataataatcaatattaaaaacataactacagtaattcctattcccatagcttattcctccccatatactaatttatcaatagttatatctaatgattttgctaatttcattattgaggtaattgtaggatttcgagatttaccactttcaatattcattataataatatgacttacgccactaattctcgccaactcccttatacctatatttttttcagttcttatttttctcagattatcacctaacataattttcaccttttttaaccctaagctcatagttttcaattttaactaataattttgtcaataaaaaaaggcttagaaaatctaatcctaaaattataaaagtattcattttaaaccagctccacaaaaaatttgcttatattctatattcacttgttaataaaacatttttagtatatgttaaatatacttctccatatttatctgtaattttgataatgttatagtctatctcatagaaatcaacttcaacttctatctttctatctcctaaaattataatagctttttgaattgtatcatcactatcttctacaacttcatcataaatattatttttgcttgtttctttagacgtatctaaatattttaatgtagacattgctattatagatataatcatagccattgctgatagtatagtacataaaattattagtatttccatttaaatcatctctccttcttatttaaattgttttatctttaataatttcttttatttcatatatcctaatctcagacaaaggaataagtatattcttatccccttcttttaactctattgcatttaaagttttatttataaaaaaatttagtatttctgccttatcatgcttacaagcactaagtaatttaagttctcttacaacaccatcttttgtcataaaaattaatctatactcatacttaggatttaaaagctctactgataatcctgaacgttttcgctttttattttccttatttaaagtataaaatcccaataccataactatgaaaattattactacttccatctaaatcaactctccttttagtattaatctttgtttagctctattagtacaagttattaaagttatctcttttttatttaaatcttgtgttaataagctaggatcattaggttctacgatttctcttttagttattttgtatctaaataactcattgtccttttgaacctcaaccgtatcccctattttaaccttgtataagtttttaaatattgaacctttcatgttattgtgtgctgctaaaattgtatttccgttttctccgaagttcggactatttttatacttggcaacaacatagtttaagttttcttctccatctactataggagcttttaagttaataccactaatttttaaaatagcaattgttcctagattattagtagcactattattatttttattccctttatttttatatgtatttgaagtttgttcttgagatttatctattataatctcattatcttcggctatttcatttgtattatcttcctttgttctttcctcatattctttgattaagttatttggaatacttttggccttaaaatctaaaaataatgatactgctactaaaatagcccctattatacttaaaattactaatacttttttcatcactgactcctaatatacgctaatattatatttcctaagcaaattattattaaataaaagctgaataaccagctaattattaatgaaccccaaataatattttttaaaattctattcttaatctcttttctcaataaaaatattgaaataaaaatatctaaaaaaatatatactattgatgataaaataaataatttcatatcatttgaaacaaagttatttattaatcctaataatataattgagctactggttaatataaaacctgtaaatgaatgggtgtataattcatgtattgcaattgatagtcctataattaacgttataattagtaaaaaattcaaaaatccaataatcatatttcaatctccttaaatgtttaaatcacaccattttttcaaagcattaaataaatatacatttaaattttctttactaatgtttttataaacactatctttcttcatcctcaatgatccattcttataaaaaagtattattccaatatcttcaggtattaacttttcaacttcattgaaaagttcttttggaattacatagtaatttttgttaccaacaaagttatgtccatttttagacttaaaatcagccttacttattttaatctcaaaacaagtagtcattattccataatctgctttatctaaatctccacgcttataaatacacccttcacatttcctattacatttatttctttcaatgcttattggattattattcctaccacataaatagacttcatcttcattttttatgtagttctcaaatctaataaaatcaacatatccagtaataacattaacttcttctgcccatcttatagttctcatattgcttaatataggcttataagttcttaatgctaattttatgttttttgttaaatttgtttccaaagtaactcccccactaactagcaatattattaatactaaacagtttaaaatatgtttcaattccatactcaaaaaaatatctctttaaaatgtcctctaaatcatatctttgttttttagaacaattcttcaaaaattcttttgataatctttctatttttgaaagcaaataattaaaatattcctgatccttttcatttaattttctgtttttaaaatgaattaattccaaatctaaattttcaatttcatttaatattgctctagccattttttctcaccctcaaattttatttacattaattattttccaaataaaaaagccctaattaggactaaaaaaatctattattcatctaattatttaatcaattccataatatttatcttcctttgcagctactctaaataaagataaataaaataaaaaacttactatccatattcccagtataattacaactctcattcccaaatgttactcctttattgcctcatgaaattcttcatatttgctaaattcattatcatctttgcacccaataactaaaacgtcatctaaaacaaatatattatttccattatcatcaacaaactcacatttaattgaaccaattaaagtttgaacattaaaatcttccaaagtccaaagatcaactatctttcctccagagtaattaataactacgtatttttttttagtttcatctccacttttagaagctaaattattttctaaaactccactacaaccaactaatcctaaacttaatgctccaactactaataatcctaaaattttctttttcataatcacttatcccccaatacctaaagctttcttaaactctttctgacaaaatattgacacattctttgttttttatatttgtaagccattctttatatatttttagggagtaggaagaattacagggctattttttactccctaaaaactaaaaaataagaactaactaataaatttagttagttctataaatttaacattatgctctctttctcttagtaaatgctaaagctcctaagcttccagctactaaaagtaatccaagtggtaacatcatatttacatcaaacattccacctgttttaactatttcaaactttttatttgttaagttgcacttaataacttgtccatgctctgttatttcaaattcaccagtttctgtagttaattcgtaaccatctggagcttgtgtttctgaaattctgtatttaccttttaaaagattaaatttattcccttctttgctagaaataaactcaataactttacctttatctaatccttcaagacactctattttaattttagctccttctaaaacttctccagtggcaacatctgttttagtaaactctaaaactcctgttgttctttcattctttaattcagcttttattacttcatcagcttttacttcaaactctccaacttctgttgaaagctcatatccatttggtgcttgtgtttccttaaactgatacttacctactggaagtttgaacttgtttccttctaaagaagaatcgaactcaattttaatatgattattttgttcttctaatccgactatttctatcttagcaccttcaatattctcaccagttgtaacgtcagtcttagtaaaatcaacatctccagtttgaactttattctcaactgttgttgttatagttttaccatcttcaattatttcaaagtttaaagccttatcttcatctaaaatataatgctctggagctttaacttctttccaataatggtttccagcttctaagttttcaactaatatttttccatctttgttagttgtatattccccaacaagcttttcaccattccaaagctcaaaaactccaccttcaagtggtctttgagtatctgcgtcaattttgataagttctgcattagctcttatctttttattttccatttcaagcttaactacttgaccattttcttttatttcaaagtataaaggctctttgttaagtacgtaattccacaatgtacttacttcctcaaccatgtattttccatgctctaaaccttttaagtttatttttccatcttcattacttgttaagtcccaagtttggtctttcataaagccatctatacaagtaaatttaaagttaacatctgctaaaggttctttagtttcactatcaacctttaaaagctccatatcgcctgttatacggtcgttagatacctcaatagtataaatagtgcctaaatccttaatatcctcatatggagcgttctcgtcgattttaaaaggtattggttctataccaatatatccttcttttggttctgcttcttctaactgataatttccatgatctaacttttgaggagttattatttctccattcttatctgttgttaatgttttagttggtactggtagtattccaacaaaatttttgaatgttacaagttcgttagtatcagtatttctaacttggaatttaacaccttcaattggtgtattatccttagaatctgtttttactactcttaatttagcttgtattggttcatttttaacatatttaacataaatcttattatcttctgttatgttaacatgatactctctatctgattgccaatatccgttaggagttttagtttcaaaaaatttatactctccatgtctaagtggattagtgaaagcaaaaccgtctttatctgtaataacatgatctacaacagttccagtttctataccatcaactttaactgcctcaatatcaaattcagcaccttcaactggcttttcttcattttcactgtcaactttaacgatttgaatttgtccttttattacatcattgggaacatcaaaagtataaacttttttatcttctcttatttgaatgtcatatactttatcgcttagtttgtgtcctactggtgctttagtttctttcatgtagtagtcgccgtaatttaagtctatactttcatcatagccattttcatcagttataagcttatcaacttcgttgtcatttttatcgtatatagtaaattcagcatcttttaatttaaggtcagtaaattcactatcgaacttatttattgcaactcttcccttaattattctgttagagtgagtaatttctattgtttgcatatgctctgtaatagatacttcatactctttaccattaaggacatacttatcaggtgatttagtttctcttactatataatctctaaatggaagtaaaccacttgtagctcttccatttgctccagtagttatagtttcaactacttgattagtagttttatcttcaatgtcaaaactagctccttcaagtggctctccagtttcttcatctactttaagaatttctattctacctttaatttgttcattaacaacattaatttcagtagtttcaccagctttaacagtaactttaactggttctgcctttaaaaatcctgttggactttcaacttcttctaaaatatattcagtaggtttaagtccttcaaatgttaatctaccattctcagatgttttttctccaactacagttccatctaaatcttttaattggaacttagctccagttaaaaactctccattatcaccagtcttaataacacttaaagctcctaaagcttctttccatgaaatagataccttatcattagatggattttgtacttctttttctattaaaatcatatcttgaactgatggtgaatatgattcatatactaatcctactggaaattgagtttttacagttgttccaactttaaaacttccagttggttcagtctttgaaaatctaacataaaaagcttctccattagaaaactctgtcttcttatttccattaacatcacaagtgtaatcactttgaggagcctgaattaacttagttttataagtatcccattttcctcctccggtaacattaacactaaaaggcccagcaataaattcatcaccttgtaaagttgcttctgaattattaggtgtaagttctagtttagcttgttgagattgtggactactcatagctttgttataaatattcttagcagcactaataattctatctcctttatctccacttatagatactaaattatttacatttatcttatctaaatctgtgtatgtccatagtgctatttgagttgcttgataagcctccttataatcttgaagtcctaaactttcagcactaacatatggataaccatattttaatattgagtatgccttatcatcagcttgttttcctccattatcaggataatcatgtgatccatcaggatattgcttcaaatagttcatacaatagactgtattaccatattggtttcctattttcatgtaccacattccaacagactttctattgcttgttttatcctttacaaacccctccaatctttctattttgtttactgttgctcttaaatgttgacttgcttgtgctggtattgcattacctatcgttaagcacccaactgtaagcaataatgcctttgaaattcttcttttgaaattcttaaaaaagctcatttctctttcttctctccttttctctttaattaatatatataaaaagagaattactcataataagtaattctcttgaatttgctttaattaatctatccaatatttatttctatcttctatttcaaatttttcatttatatagcttagtggaattttacctactttaaacattccatcttcaaaatgaacaacattttctccttcttctaaaaaggaacattttgtacttttaatatcaatggtatctctttcatatattttatttccttttttatcttttactcctgtatattgtcttaaaagaaacatatcagaagtatctgttaaaagttcatctccatcttcaattgttatatacatatggataaaatcaatatttacaactggtacaaacttttttacagatgtatgtaaagctatataatctctttgcatcattttttcatcactcctaatctttgtaataatatattttaaagtaaaacgtaaaaaagaaccttagactattctaaggttctcaaatctatatttaaattaagggggaaactttatttatattaatttaattaaaaattaccattaaatacagcataataatcgccatcactatctctgtaaacggcacatacaccttctgtaatatcttcatccaataatgcttgtctatgtcctgatgaagctttccacatatttaaaaattcttgtgcagtagcattatgggttttagctacattttgaacccattcatcagcatcatccttatggaatgttgctccattttgagccatttcctcacaatgttgcttagttgcttgtgccatagctccactataatttaatctatttaatccattagcttgtctaaaatcacttattaaattaagtaattcactactcattcccgattgatattcccaagttctttgaggtttttcaggcttaattggctcttgtggcttattacttgtaccattatcattattaggcttgtccactggtttgttttcagtaggtggtgttggcgtttcaatcggtttatcttgtggtttattatttgcgttattatcgttgttaggtttatctactggtttattattttcaactggtggggtagggttattattattttcagtatttgttggtggtgttatattactttcagttccaccagttgaattgtttggtttattttcctcaactactacatcactttctgttgtagtttcttcttgattttctttatctaattctttattttcatctgttttagttgtatcttcttttttatcagctaaagctatgttacttttctctatattatttttagagtaatgactatttatagcatatccgcctattccaataactgctattcctaaagctactgctactcctatactttcttttctatgtaaatttacaaattcaataattgcctttatcttcttattcaccttaattatctcctctcatacttttaacagagtttattattatctttttaggctctattttcttattcttatttttataaaactctgtacaaattttataaattaatcccatatatacctagttaagataatttgaattataaattatcttctgctcctccttgcttaaaattctaggattactcatttccttagagtaatgagatgctacaactctaccaacctcattgcctataattggtctaaattcctctctaatctcttccctagaatcattgttaaatctttttggagtatcccaagtaactttacattctaattcattttcagttttcaaaactatattaccattttctctagttttgtaaatacttctatttttaagtacaaaagccttattgcccatttctctagttgcctcgtagttaattgcttttgtagtttcttttttagcatttttttcaatccaatgttttctccttacaaattcctgagaagttgtaggtaaattttttatccatgtattaactatagttttcactgtatttacactcataaacataaactttgctatttcttcataagtaaaccccgaattatagtagtccattatctctaattgtcgtttttcatgttcattaagttcttcaacaatactcataaaaaaatcaactccttaaataattttatccaaaatccttaaaaaagggcatagttcacccaaaccaaaaaaggttttagaacctcgaattttcatagttaaaaacttaaaaattcttatataactcttaaaattctatattaattttttcaaaaatattcaaagtataaactcttaaaattaagtgcaaatttaagcactttaccttctttcaataacatactactaaaaaaatagctattgtcaacatattgaattttatataaaatccaaaacaatcactttgaattgtttttattgtatattctaaaatatttgtagaaaatataatacgaggaggtgattatattggattggacagtctttgctaataacttaaaaaattatagaaaagaaaataagttgactcaagatgatttagctaaaaggcttaatgtttcccgttcagctataagttactatgaaaatggaactgtagagcctagtatatattttctaattaatttagcaaatgaaatgaattgttctatagataacctctttggtttcaatagagatgtttctattgaattaccaaaaaatttaactaaagaagatttgaaaccaattgaaaaggaattaaaaaaagaagatttcgaaattgatgatcctaaatactacttagaaaaactaaagaaaacattattaaaagttcaaagaagttacatagagcttgaaatgtctaaaaagagaactgatagaatgtatgatgaacttgttagaacttttaatagagaagaaagatttgaagaaatgttaaatgagttaacagagttagaaaataaatttaattataaattcaatataaaaaataaaggaaaaaaagacattgaaatagcttatgaattaactccaaacatagaagatttaagaaataaaaaacttaaagagtgggaaaaccaatataaaaaaaataaagactataaaaatattactcgtattgataagtatggtaatgtagcagctggacttccaagctttgcttgtgaagaagttgaaaaattattatatttgcctaaaaagtatttttcatcagcatatgattattttgcattaacaattaatggagatagcatgaataaactatatgaggatggtgaggtaataatcgtcagaaagcaaaattatgttcgtaatggagatattataatagcttgtattttaggtgaggcaacatgtaaagagtattatttcaatgaggatgaggataaacatgaattaatacctcatagtacaaatcccaaacataaacctcaattttacagtgatgacgagattatgatattaggtaaagttgaatgtagattaactgaaattttagataaagaagtggattaatatattttcaataggtgttaagattaaagtaaatagaacaattcaaaaaggctaaattaaaataggtaatgaaataagaatagtagtttttaaacttttaaagactattattctttttctttttatctaaaattattttaaaacttagtctttttctatcgcaatatatactactccctagaaaaaataatattaatattctcaataaaaatttgtataacaaataaaccaaattaaatattaataatggcctaatagagcttcttcaagtgcagcccaatcataatcatctctttgagtaaaattagcttgtacaccttgttttttatttagctcgttccatgttttaatagcttttaatctagcattttcaatagcttttaatatatagttatcaaggaatttttcagttatatttttatagtttttacttataccattcataattgaatctctaataaaagagcttttaaccctagctttatctagtaattctcttactcttcttctaacatcaacaaagctagtacattttttgtatttagtactgtcaaaattttgagaattactataagaatctatatctatactattccctaatatcctagggcaattttcagtttcgataacatcagtattttcagtgttttcagtagaattttcatcaggtaatttattgggtaatggtagaaaataacaattcgttttttctactttttctattctgattagaccaaaatcagctaattgatttataaggttttttatttgttttaaactaatagtttttaactctggtctttctttttttcttctacctacccatctgttatagttatagtggattttagcgaatgacatgcaaaaagaaccattatttttaataatgtgtttttttagaaatcttaaaagactttgagattttcttttagattctttagaattgatttgctcaagaatagcaaattcctcagcagtaagattgtattgtttttcttctatgttagatttattttttaaatatgtattaaatgttttcataaaaaaatctcctttcaatgttctattaactttaagaaaaatgaaaaatcctaaaggtactaaaaaattttgaaagaaggtttagttatactattttaaaacaaaagtcaataactgtgttgacttttttctttagatttgatatattaatgctaaagaaaagtttaaaaaagtacattttatgtacctttgggtgttcccattaagttgtcttagattggtagtcgacaaacaacttaatgggtgttttcattttaacccaaacatttattaaattgacataataataacatgtaaaagaaattttttcaagagagtaaatttgtagaaaacagatttactctcttatttttttataatacaaaataatttattgattttaaaactaataaattattttgataatataaaaaaatatatataaacaataatttcatattactaaaataacaaaattatattattttagtaatatgaatatgttattatgggtaatttaatatataaaactcttttaataatatatattaaacaataaaataatatttatgtaatataaaaatattattttattgacatttcattattttaataatataattataatataaagataatacaaatagaaggagcgattaaaatgtgtatttattttaaagtaggaaatgataatgggaatagtgaacatgatattattatcaatgatgtgcttatatcacaacctaatgtatattcaaaggtgagaagattacctaatttagatgaagttaataaacaatatgttatagaaaatatagaaaataacttaatagtaacatgtgaagatccatctggaatatattatgttggtaattatgcactaagttcaggacaaaaaataagaaatgttgaagttggaattgataataataaaatagaaagtgatgttattcttatcaatacattagcacagatagctggacaagcagtcaaagaatattatttaaaaaataaatcatttgaagaaattataaaagttaaggtagatatggctactgcattacctatatctagttattctaataaaaatgcaaagttattttcagaaaaatttactaataaaaaacactttataaccgttcatattggaaatgaaatagcgagagttgaaattgaatttgaatttgtaatggtaattccagaaggagtaacgtctagttttttatttacgcaaacagatgacattttaaaaaaatataattttaaaaaggaattttttaaagatgcaaaagttttacatgttgcaataggagaaggaacagttgagtatccaattacaaaaggaatagaatttaatcctaatttcataaaaggaagtaacaatggtgttggtcatgctatagatatggctttagatgaatttaaggaaacaaaaggattaataaaattttcaagacaagattattcagaagttttaaaaaataaaaaacataaatataacgaattagcagaagatataattgagcaatatattgaagaacaagcagaagaaatatttcataatgctactaaagagatacagaaagcaaataatgatatagatgtagtttgtgtttatggtggaggatcaattttaatgaggtcagctttagaagaaaagtttaaaaagttttgtgatagagcagatataaaacttctttattttgataatgaagattgtgttactttagaatcattaggattaaatgttttagttaatagtaagttatttaagactttaaaacaaaatagtgcagtataaaggtaacaaaagaaaggtgagtaaaatgagtaatgaaaaaaagaaaaagaatcctaatactttttcattttcactaaagaaaacagatggtaaaattattagagattttattagtaaacaaagcaatttttcagaaactataagatttttaataactaaatatgttatagaaaatggagtagaagatgtttcagggaaattaaatgaattactattttcggctttagaaaacaatatatacaatttagaagaaagtaaaaaagtaaataatttagacacgaataaaaataatgaaattgacaaaaaagaaaagttaaataatgaggaaattcaaaaagaaaatttagatatagaagaagttccaagttgttataagataaattaaaaaagtaatgaatattattatgtcaaagatatataacataaatatctttgacatataaggggtgagtgtatgttgggttggttaatgttatttcttttttggatagttctagctttaggaaatcctgtgattgatttattgaaatatatattaattatttatgttttatattcaacttggggagatataaagtcatttgaattaatgagagcttttgaaaatatattttatatgacagtgttatttgttccacctatattctttaaagataatagcaaaacgcaagaaaagaagtgttaaagcacttctttttttatccatctttttaattatatcataggtaaaagtgaattaacagtattgctatattaacgtttacatattataattatcattaataaaaggaattatattatatatattattataaaaaggaggaattagttatgaaattattaaatttatattctttattaagcttttcaatgattattgtaccaattataattgctggaggaatttatgccataactaaattacttcctaaaagtgaaggtatcataaattacgaagagttttaaataaaaaataagtgtatatcataaatgatatacacttatttttttgactagagttgattttgattttctattctataacaagtatataataaaaatatagtaaaataaatattaaaatagtcctagaactctttttttgctttttctcttagtcaaattatttaaagtagattttagtgtttcaagttcttcagataaatttttataatcttgttgtttttcttctaattcatgtattctattaaggttattagttataacattattaagaatagcaatttgattatcttttaaatcaatttgattttttaaaacttctataggattgaatttaaaatcttctttttcttgtatttcattaataggagtattttctttagtttcacttttttctacattttgagtatttataatttcatcttcttcaattttattaagtgatcttttattctcaatttcttctttcagtaaattaaatagtttattgcttattgctacttgtccgcctttcttttgaactaatggagaaaagcgtttttttctaagtaagttatatacatcacttctacttatatttaattcatttgctacatcttgagcagttctcattgaaaaatcctcctaaaataataaatcttatattatctatattcttgaaaataatggaaaatccttcttgtaaatattattatttagaaaattaattattttgcttttagaaggatagaaaagctatcgcttttcttttaaaattatgtgtttttttgaatcactagcctatcatatctacattaaaattgtaaagccatttcacaaattttttttatcggccattcattatattcatagcagctaaaaaaattttgctccattttcctttacaattcattccgatatgacattctaggctcaacaaaaaaacaacaacacgaagtgttaacgctagtatttaagcgaaaggaggattttataatgaaagattatgttattcataaaagctttggaaaagtaggatttgaaaatggggatttagtaagagtagatttgttagatggatttaaaataaaaaatattcctgaattaaaaaatttcaatttttactatgaaattaaaggtcatgtagactcggcttttagaaaaggtaaaaaagtagaaagaaaagttagatatgtaagattatttaataaaaagaaaagataaataaaaaaggcattaccaaagaaggcaacacctaatgtagacaattagattatagccttttttggtaagctagtcaagaaaggaagtaataatatgagtataaaatattttaagaaatttttagatgagttgagagagcaaggaatagaaattaaacatttaaaaatatatcaagtttcagaaagtataaagctttttaaattaatacaatatggtagggagcaataggtatgagagtagttacaataattagcgaaaaaattgaaaatttaattaaaaataaagaaatttcacaagaagaagtacaaaatttactaactagattttgtaaaaatgattggggcgttttagataatgaagaaaaagaagaacaaaatgaattacttatagaaggaaaatgtaaaggagaaaatcccaaattaaaatattggtttaatggaatatatgaagttgacaaatatttaataaatattcgtagtaagtatgaaaaattaacaaaaaccttagagataagtgtttatctaattaagtaggattaggggattggatatgaaaaatgagttaataagaagaaagatattaaaatttttacaatggaatgataaaaatggttactatacagataaaatgtgtgatttagaagaagttccaagaatgacatatgaagatagtatcaagtatttctttggtgttttaaatgaggacttttattgtaatttagtagataatatttttgaattagaatatgatgaagtaattaagtatgctaaaaataatggcttttatgaaaaaacgtataaaaaattaaagttattgattaatactaatgattttaaggaaaatttattttatagaaatttattaaattaaaaaagataagggagcatattgatatgatcccccttaagtagacacaataaataaacaaaatctacttaaggggaaattttttatgtctagaaaagttaaatactctcctgaaatcaaagccaatgtttgcgaagattacttaacaaataatctttctatgcaagaaatttgttctaaatataaaattccattcaatatgaaatcatatacttgttctgtttataaatggatacctatttacaaaaacttcggtatagatggtttcttcaataagactaaaaataatagctattctaagtcttttaaaattgaaatggttgaaaggtatattcaaggagaaggctcgatgagacatcttgccacaaagtataaaattccatctgattcaacactaaataaatggattatgatgtataatgccaatagagaacttaaggattacgatcctaaacaggaggtctatatggcagaagcaaagcgtaaaacgacactatctgaacgtaaagaaattgttctacattgtattaataataaccgtgactataaaggaacagcatcactttatgatgtatcatataatcaagtttattcatgggtaaaaaagtatgatactaaaggtgaagaaggtcttaaagacaaacgtggtttacacaaattagataatgaagttgacgagttagaacgattacgaagagaaaatattcgtttgaaaaggcaacttaaagaaagggatatggtggtagagctattaaaaaaagtgaaagaattggaaaggatgtgaggcttgggaaacaacgccatgagtcaaagtatattgcaattgaatatttttatactaacaaaagatggagcattaaatggatgtgtaagaacttaggtatttctagagcttctttttacaagtggaaacatagaatccaaccggaacaagaaaggataaacatagaaatatctgaactggtaaaagagtatgatgaacgattttctcatatcttaggctatagaaggatgaccgaatggataaaccactttaatcatactaactattctaaaaagcgtattcatcgtattatgaaaaaactcggaattcattctgttatccgtaaaaaaagaaaaaaatataatccttcaaagataggagaaatcgtggaaaacaagttgcaaagaaacttttatgcaagcgctcctaatcaaaagtgggctacagatgtaacagaatttagagttcctaagactgggaaaaagttatatcttagtgtaataatagatctctatgaccgttaccccgtagcatttgttttaagtagtagaaataataatcagttggtgtttaaaacatttgataaggctatttcagaaaacccaacggctaagcctatttttcatagtgataggggatttcaatataccagtagagctttcaagaaaaagattaaagataatgggatgattcaatcaatgtcaagagttggtcactgtatagataacggtccgaccgaaggtctttggggtatcataaaatcagaaatgtatcaaatgtatgaagtgacagatgaagcatcattgcgttatgcaatcaaagattatattcgtttttatagtaatgagagacctcagagcagatatagttgtaagacgcctgccgaagtaagagctgaagcattaaattctgagtttccgataatatatccaattccaaagaacagaagaattgaaaaatataaagaaaaatggtctgcataaaaaaatcagccacacgaaatgtgtgactgatttagaccataagcttttgatatttaatctgtctacttgacagggagcatatcacatttcttatacttgctcctttttattgctaaaatatttagtagactttggctatagagtagtatatacataatcttatgcattttcaatattttaaaagtaaacaatttataaaacacacatatgttatatttaaatataacatatgtgtgcaattgaaaaagaacagttctttatttaagaactgttctttttaggtgtaatagagtttatagtttgaaactaattaattaaagaatacatagttgatactgatccatctattaacctaaacttgaaaattctaaaacattattacagtaattttaatattttagtctattctaacttatatgtatataaatttcaaatattttagaataatttatatgttccatcatcagatttataatagattttagcatagttaagttcattaagtcctttaaaaagagtaaactcatccaatacatccaggactacatcgggaatatcatagtctttttcataatccggatcatcttcatctacagcataattatctctaattagttttccgttattctgtacttcaacatttagaccattcattatactatacatacttaaagatcttgcaaaatcaattctaaatagaagctgcatatttctatcatcagtttctatataatcccttattagtcttgaagtaatatcctgttcatggtctgcctcgaatactagatcctcaaaaactaatacatattttctatttgcattatctatactatcaattttttgtatccactctttttttagtctaggagcttctctttctaaatcatctcttgttttaactaaattcatacttttaatacacctctcaatatttttactcacattataactcgaaaataaaattttaaaagatatttttatataattaatttctatttttctttattttcatatttttttattaaattataaaaagaatttttctttaaattcattagttccatagcctttacaccagtgatttctttagctttccatttatcgtatacttctttaaaattatctggatattttactcttggcctacctaaatgttttcctttagctttcgcattagcaataccttcggcttgtctttgcttaatctttactctttctttttcagccatatagcttaataattcaaatactatattggatattaaagttttttctaaattacttttaccttcagtatttagtataggtgtatcaataacaactatatttatctcttttgcctgcagatcattccattcttctttaatttgtgccatgtttctacctagtctatctagctcttttataactaaaacatcaccacttcttaatagctgctccttaagtgttttatatccttctctattaaagtcttttccactttgcttatcagttattatgtctctttcatttacaccatactcctttaaggcttctatttgtctatctaaattttgctctttagagcttacccttgcatagccatagagtttactactttctatattaattacccgtaaatctttatctttacctgtttcaatataactttccataagaactttactgctaaaggtttgagtaaatttttgatctgagtcaccatatacataagtcaacttataacgcatttttatcactccatatttaaattattactttaagtatagaaaaaacgtttattaaaatcaattagttttaataaacgtttaaaaacaaaattatatacatttaaaaacgaaaaataaataaattaaataaagtttataaaggtgaacttttataaactacaaaatgaaagtaagaaaaaaattatataaaaacttacttttatttattgtttttaatgaaattttttaacaatatccctttttcttataacgaattacactaaggaaccattatacaatttatatttttatctttaaccaaatctataaatttttttaatctatttgtaggagttaatatttctggatttatagatacattgtaagttatattaaactttgataattcaataaattgttctaaacttattaagtgtacttaggtagacatatataatctaaacttgatatttttttaaatatagtaaaaataggcataaaaataccgtgtttagaacacagttttcctattcttcaaataaagatgtaatatgctcattataatactgattatttttagagtacacaaatagacatggtaatatcaatattattaataattgtttctaccacaaataaaccttgagttatccaagatttttttcatatactttttaaaataatccttattcagttagtttagttaaaaactaactctttgcgcatatttacatctcctttacatttatatttttcatgtttatattttagtataattacattatatataaacttttatttttttcaatactatagattagaaaaaacaaattctaatttgctgaaataggtgaaaaacgaagaacctatgaataaaactacaataacctacaaaaattcaaattttagatttttgtgagtttcattgcagaattaaagcagacctacctttcatttatatatccaattttggtaaagttcgcacttacttgtgatacggttctccgtatcagcattaagtgaggtttttacaatagttattttatttttttatactaaaaaaggttgtagtttaaactacaacctataacaatctaaaattatcttctattttgttctttcttagctcttctacaagatatacatcttgttggctcattttcaaatcctttttctttgtagaattcttgttctcctactgaaaatacgaattcacttccacaatctctgcattttaatgttttatctgacataaacattcctcctaaaattaaagattctaaattgatataataatctctaattttcgagaaactatttacctaaatgaaactttttttgttagcaactttgctactcttttataataacatagtatttaattaattgcaacctttttttaattatttttataaataattaaaattaacacaatatttggtatttaaccatgttatctttaccttattttaagtatagtttcattattaacaatactttctatataaaaatatccaaatttaatacactgattagaatacttatttacttatatattttactaattatcagttatatttagatttattgaatctaattttcttaatacttaattattgattatgatactatactttctgaaataaaatagctactattgaagtaatatcaatactttacaaaaaaactcatttatttatgataaggttccttaatagttattctaaataagtatcaaaaggcaccttaatttattcaaggtacctttaactgtgatatagaataaaatttcagttctaattacttttcttttaccccaatccaaatttcgctataaacattttgcatatctgacatatctctattgaaagatatttctggaacgtttattaattcataatttgaagatggcaaccattcagataaaatttttccccatgtatcttgaaatacagttggaaatggtcctttacaaggaaaaattgcccaagtacaagcaggaacttctacaacatcaaattcaccaaaatctatatctaaagtagttatagatccaattaagtgatttaagttacctttttcttcataccttttatcatcaaaatcaaatgaagcgttaacaacagttttaacatcttcatttctatatgattgtaataattttctttgttcttctgttatactttgtgctattttcattatttcttgatttataccttcaaacacaataggaacttgacctttaactcctactaatttaaaagcttcttttttttcaatacgataattcatattacttcctcctttaatagttaattgaaaagtcatacaaggaaatactttaagattcttagcatctttaatctctgaaggattcacaccaaaccattctttaaatgccctactaaatccatctgctgaatcatatccatattttatagctatatcaattatttttatatctttttgcattaaatcaaaacttgctttagatagccttctttttcttatataactcgaaagtgtcatacctgaaagatacgaaaacatctttctaaaatgatactcagatactcctgcaatctttgaaaccatattaaagtctatttcttcttctaaatgcgtttctatatactccataactttattgaaattggtaagcatatccatgtataatcactcctcatactaacaattataatttttagtaatatacttttatcgatattatctatacatatattatcgtactaattattttttaagtataactaagatctaaattatatatataaatttttattcttatcatccgcgctaccttacttgtggtacggttctctgttacacctccaaaggagcacgttttactttaattgttctaaagccttacattttttaagctctttcataagttctttctctatttctttatctaaatatctccttggaattatatgagctacaaatccacttatatataaggatcatatcttcgtaaacttttacatcttttatactttctaacgatactgtttctgatatagaatccccttttactactattgtcccatcaataatttctaaagtcttacttccaaatattgatgaattatctccttaacttatgagtttatcagtttctttagctactaattttttgtattgcttaggatatgttaaaatccaaatgactaaaaaaactatcgctactataatccaatatatactcggttgattaaatatccccgttcctgtaaagtagattggtatagaaagtactatgggtacagcatatctaagtatgttaaatgtacttttctgtgatttcgagttttctaaatgatttaaattgaagcttatatagtcatcttttgttattttaaagtcgattttcatttgtgccgtccccttattattaaaaactttatttacattatattacaaatttcaagcacttacaattaagcatagtaacatgaaaaaaggaagggtcttcatcttcttcagacgacccttcctttacttttaggctttgaatgtcttatatttaaatcctacatataaaaatttaacttatctatttaaatttaatctctaattgcgtttagtttatgaagcaaatactcttttttattcaatggatcatacgttgtttttttgcgtgcttttgaaaattcagctgaagcttccttatacccataaaattttgtcacaaacattcctctaccttctgtatatgaagctattttcattttatattcttttgaattttctactggaattaatccctttattgagaattcatcccctataacaataggattatcaaaggttgccctcatagtttctaaatcccataccgctttgcttaaagcattttgaggaatctttaactcaaactcatgtaatggctctaataaaacagtttgtgctttatataatgcttccatgaataccataggtgtcacatttctaaaatctgctggagtgctggctggactaaaaaattcaccacagctaagagtgacttttacatctgtaacctcccatccaaataatccttgtttacttgtcttaataactgcttcttcaattgcattttgaaaagattttggcaatgaccctactgaaacattagaaatatacctaagaccttcgcctctccctgctggttctatttctaagcctactgtcgcccaaaatggatttaagtcttcctgcatatgcattattgacgctccaaaacctttaggtgtttccttatagatagtctcaatattcgaaaactctacttttattccatataaatcatctaacatggaacttagtatttccatttgaacttcaccgaataagttgacataaatttctttatctatgtcattcatctctaattctagtagtggatcttcctctgcaagtaatgttaatgctttaaatagctctggatttttttctttatcaattgcagaaattgttgtttttaatgctggtttagctatagatatatttttaattttatcatttgaaattccaataacatctcccacttggaaacttgtaagtccatataaaatacctatatcccctgcttctatcctctgtgcttcaacaactcccccattttctaacctattaattttctttactttttctgctatctccttattaggtacttgaattttatctcttacagatatttttcctccaaataatcttacataaaccttcttttcatttttacttgttctttcgattttaaatactaccccagataaatcactttcacaatcattacttgcaaatggaaaataactacaaattccatctaataaatcttcaattccaagtccaattgctgcagcaccacaaaatactggatatagacttccttctcttgcatataatgaaagcttttcttgtatttcttctttatcaggttctattccaccaatatatctttctaaaaatgcttcgtctaagtctgataaaacattaatagcatcatcatttattatgcatgtatcaaatagtttttttatataaacagctttgcttcctacatcatatacttcttgtaatctaactactttattggacatattcttctttatttcttcaaatactttgttgaaatttgccccaattctatctagcttatttacaaaaattattgttggaatatttaactcctttaatgtgtcaaataatattcttgtttgtgactgaatcccctctactcctgatataactagtattgctccatctaagctatttaatgaacgttcaacttccgaaataaaatccacatgtcctggagtatcaataatattcaccttaacattattccaattaaaagatatggttgacgatttaatggtaattcctctcttacgctcaagctccatagaatccgtctgtgtattgcctaaatcaactcttccaactgattttatagctccactataatataataagttttctgttatagttgtttttcctgcatccacgtgtgctacgattcctatattaattattttcttcataatcaatacctccaactctatcatccacctttttatcaattatcatagcaacaatatataacactaataccggtgttactaataacgaagtacatgctataccaatacttactgaaatatttgtagctatgattcctataattggtccacctaaaatttgacctaaggaattcatttgtccatttatagaaagtacagtagctctagagttatcatctatatgcccatttaaccacgcactgaatataggttcatttataattctaaaggtatttgttgccaaataagctattaacattaaactaaagttttttgtaagagcaaatatcaacatagacgatatataaagtatatttatacataataatagttttccatttttcctattatcctcattcttaagattctttgccataaaatgcattactatgaagctcaatatcattcctaaaattccaaaaattccaaaccaagtcactgaactaaggtttccaagcttaggaagtgtagtatcttgtaaaaaatgtgcattagaaagtctatcataaccttcacttgataatccataaaataaagttactgcaagtaaaatcataattatagatttactttttacaattttaagaccagatttaaatgtatataccatctttttgaatgtatttaaatccccaggagcagatggtttaaaattattttctggcatatataaccataaaaataatgcaagaattataaataaaactccactaactataataggaagccttacagagaaattagctattacagtgcttagtactattccaataaatgctcctatctgccctgcttgtgctccctttatataaatttcatctaaatctttattcttctcttcttctgcaatccaagcttcaagcgagccactgataaaagtagaccctaatccccatacaatctgtgctacaagtacgaaaacaaaactagaaatagaaccttctaaaataaatcccactcctgttaaaactcccccaataacaatagatagtttacgactatacacatctgcaactatacctgtaggaatttcaaatataaagcatgctaattccaaagtagttccaacaagtataagttgaagtggatttaaatgaactatttcaatgtgatacactaccataactgtagctactaacgaaaaacacattgctgcaatagctgaaaataataaataagttttatatgctgaaagtttattaaccattaatcatcaccatcctagtatttcttaaaaaatttgtttgtttttcataatcttcatatttaaatatataaatcatcaaaataatctccttaaacaaaaaaaagctgcaaatgaacataattcacttacagcctcataatcatataacctaaatataaacataaaatatagaactttaattatataacttatgattaagctattcaaattaaaatcttataccatatctatatatagcaaaaatagacataaaaataccgtgtttagaacacggttttcctatcctgcaaataaagatgtaacatgctcattataatactgattatttttagagtacacaaataaacatggtaatatcaatattataaataattgattccaccacaaataaaccttgagttattcaagatttttcatatacttttaaaaataatccttattcagttaatttaattaaaaattacctctttgcgcatatttacaacacctttacatttatatttttcatgtttatattttagcataactacattatatatttttttttattttttttcaatatttttatatttatatttatccaaatttaattaaaatcaaaaaagactctaaattatagagtcttttttagttatcacaaaaatattactaattatttgtttttttctcaagctttctattcatatagaagtatcccattaatccacctataatagcacatattataattatattcatactatttcctcctttattaaatatctttttttatttttaatatttcttcttcacttaatcccgttattttagaaattaaggatatttctaatccttgatttaaagactcctttattaactctaattctctttctatctttcctttagcttcagcattttctaaggcagatattctatcgtatattgccttttctctcatattatactgttctctttcattactatccatactaagtctatatagttcagattttgctagtttaatttcttcattacttaattctaactgccttacagtattactttctggttcaactaagaattctaaccatttttctaaagcatccattttctcaacattttcaacatactctttattaccgatttcattaaatttaggtaattcaatgaaatgtatttcttgaagatctgtcagctcttcatttgaagttatttcttttagcctatatgcattatgatatttatcattctttaaatatttgaaatttaagatatttatacaaacagttctttctaacttactgtagttatctctattttgtatttgttctgaatacattttactccaataatataaggtcctttgtatcatgttatattcattctttacctggatttcaatatttatatgctctttattgctagttgtagcctttacatctaatctactaaatttatcttctataaaatctttatctatatcgttatttttgatttctacatcttttatgggagttgttggttttattactgcgtttaaaaagttaattaatataggtttattcttttctgtaccaaatatctttttaaacacaaaatctatttgtggatttagtaatgttctatacaccattttaatttactcctttcaatagttatactctaattataatatagttttatctaaaagctctaattaaaatctattttttagaaataattcagctttcttcagaaaaggtatataggttacatagtctctatttttattaaatccttttctttcatgataagttgttatgcaagctttaaatatactatgatctgggtaatatatcacaagcttatagtcaagatctaaatttaaaggtctcctaatttctaatattctatctacactattaatagcactagttcccccttttctattctctagactatcaaaaacatgaatacttctatttagtttatctatgtacacttcaaaataattatatccattaaggttattaggtaatgctaaaagatatgtattatctttagcattttttattaaataactttcaggatttatttcacctaaagatttatcaatcactatcatactgccatttcctccccacttatctttatattttgattatatcataaattaattaatgaaaaaagatttttttcattaattaatttatgatataatatatttaacatattaaatataaagggtgatgatatgaaggataatttaaaagaaatttttctaaatgaacttaagaataataaggacactccaaaacaagaaataataaaacttgctgaagaatatggaatagattttaaacctagagaagctaaatctaaaattatagataaattagttgtagctggagaatttgatactatttttaataagtttgaaaagtttggatacattcctacatggacaattgctgatttttatggtgttaatactgaaagaatagatcagcttcataaaattggagcaataaaagaaatacccgttaaaagagaatattacagcagatctagtaaatcatattatacagttaatacatatccagttagtgttttagaatattcaagagaagaattagaagaagcatataatcaaacttatggccaagaaggatttaaatttagaattgaaactaactcaaaagatgaagttgaaatattaattaatgaattaagaaagctttttaaaatagaaaagacacctcaaatatatgaaagaagaaatgaaggttataacacttattttacagttaaactattgaataatagtgagtttgaacaaaataaatttttatcagaaattgagagtttaaaaaataaaaataaagaaactgaagaatattatcgtgatgtattatcaggaatttataagaaatttaatgtagatagtagaatggatttaatgagagtaagtcgagaatatttagagcttaaagaaaaatctaaaaagaatagtcgtggagcaggtagaaaacctagatttactgaagaagaaaaaaatattataagagctcaaagaaaagaaggaaaaacaataaaagagcttgcagctttaaataattgcagctttggagtaattcataaaattttacatgaataataaataaaaggggattgagatattatggattttattttagtattaatagttttatgtatatttagtttttcaaatatgaaattaattaagcttggtagatatgtaatgttagtgtattatttttatgctgctcacaattattatattgttgggaattatagtggaatagcttatttaacaggaatgtttatgcttttatttttaccaaagatattaagatttatatttgttttaaaaacaaatcgcagatattattaatagtaaaaagagcagctcaaaatcccgaaaattgaactgctctttaaaaatataattcaaaaaatgttaacaattttattttatcaaaaattaatatttttgataattattaatttttattgtaaaataattatatcttctactatttgaagattcttgaatctatctaggtagccagttatttattaactggctttattaattttagtatttaaagtataatattgttaagctataagtttcttgctttttgcctttatatatataaacactaaaaataaagttgcttatttttaagtaactttatttttttattcaagtaaatttctatataaattttcattaggattattatctatcaataattttaactttttataagtttgattataaaacttataatctttagcatattttattgtttcgtaaaagcttaactcaaagatattatcagctattgaataataaaactctgaatttatcactccaaaaaaatattttatactttcttctaatgataatttttgaacttcttccaagtcacatcgttcgtcagtataataaccatttttatcattccattgtaaaaaggctagtatctttcttcttattaaaccatccaaggatcatcacttcctatatgttaaaaacaaaaaagaaagtattatcaataatactttcttttttataaatttaaatttttaatttatagacatatttttatactattttttgagttatattatattttttgaagtaaaaatcttcttcaccatctagaataaaatctaaatttttttcaattttcaccatccactttggtgatgaattagttttaataaattttatatagcccattttatttaaattatttatacagtcatcaaccacactaggaacatggtttgatgttttattatcataaaaattttcatacacatcgctgactaaaatcctggaatttatcttattactaggacaaaaattgtcatttagagaacattgtttataaattaaaaaatatgttctaacaaccatttctgtaaattttccagtaggattttttctttggcttaaaaagtattcctttttatccttaatcttttcttttgaccatttcatataatcactctcctaaaatattatacttattatagtaaaaagaaagtatctaaaaatagatactttcttagttataagttgaaatgtgaaaagctataattatgatataaaaactcttaaaagatacaccttaattataactttaaacttaataaataaacaatatattactctttatttttcttgaaatttaagttaaaatatttaaaagactttatgtataagtgcctaagttaaacaaagaaagtcctacttatttttaagtaggactttctttgttttcttaaattacgtaaggaaaaatggctatttacatagtaaaagcttaaaattattataatataaatttaggctattatgttaagaaatttttaaaataagaaaacgtttaattttttctttatttataattataaattttttataattataatatattcattttgtatcacaataaaagtcattgaaagagctctgcttagatttactaagtagagctctttcgttattttagtttaataaaaagagaaatgattatttattgtaatacttgtaaatattataatattattttctataaaagtatattatctccattcatttttcttaaaaacatttagtattgcatttttatcttttctacgtggaaatgttaagtctaaaaactccatcattttctttttagtttgtgttccatctagccttgaagtattctttagaatatttcctctctttttgaaaatttcatcttcagtatctctaaatctagctttttctgaagcatttattataccggcagccatttttatattagcctggatttgcttctcatttaatgaaccgttaaaatgcctaaattcaactgtaggagctctatctcttgctatattagttaagttaataccataatatctatttccttttgaaacttctgctgccattcttcttacatcttcatcattatccatattaaatcttatatatttactttcatcggccctaggactaaatggagtggcataatgcctagcattacttcttactcttcctaaatctccacctgcagctctataaatacaatcctcatatacttctatagtcttaaaaaatcttctccatctttgtcttgcagtatctagtttttccatgtttatatgaacatggccaccacacctttgatctactctagccccatgtcttttagcaacatcacatattacttttatttgttcccatgtctttggagtatctttaagaataggagaaactatttctccaccggcatctccatcggatacggaaccatctctctcaagcttccatttgcctggctcacttcttgagtgatagcctaatcttctaggagaactaactatacctaaatcatagagttctcgtgctatagcattagcatcaccaccaacaaattcaagttcaactccaaatgtactcttatttccgtttagtacgttttcgtactcatactctatagaatcgtcattaatttctgcaaaatcgttatcgaaatcaacttcattgtctgtataaaagtgattatcgtcttgttcttccccacgaatatttctatttatttcatctcttatatccctagctcttctagtagtttctacattgtttatagtatctacttctgcaacttcgcctaaagcttctctgaccgctattaagtgtctgcagcattcatttctataaacatattggccacattcacagctattttcattcatatcaacaaggggtatcgtccggaaaatgcggatttcacacgttaagagcattttcccagctgataccaagggtttgcagactttttagatattcaaaggtctatatagttctgtcgattctagttcatttaaattaaaagtatattcccctaacatatttatgtgttcccaacccaaaggccatggccgtcaacctaagaagccttattttctataataatgtataatatttaattaattattatagaaagtgaggcctaattttatgaacaaaaaacttaaatatttatctaaaagtataaaagaaagtttcgatattaatgaaataaataaaatagcaaaagatacaaaattcattcaaagaaaaggcagtataacagctaaatattttttgatgtttaatgtattttatggctcagatatctgtatagctccgttatcacaactagtttcaaaatatgatatgttattttctaagcagctatctaaacaagcattagataaacgttttaataaacactcagttgaatttatgaaagaaatatttgttaagtttttatattctcaaaataatacattaactaacttagaacgtactttaagaacatattttgatagagtcataataaatgattctacaagttttactttacctaaagagtttaaaaagaagtttccgggttccggaggagtcgcttctccatcatcaataaaagtacagttgcaatatgagttgttaaccggttcatttatgaatatagatatattttcaggcataaaaaatgatgttgagtatttgaaaacaatgaaaaaatataaagattataaagacttaaaattagctgatttagggtattttaaaattgattatttaaaaaggcttgataaaagtgggacatcttttatatcgaaagtaaaaagcaatacctcattatatataaaaaatccaaatcctgaaaaatataaagttggaactataaaaaagtctagtgagtatataaaaatagatatcattaagttagcagagcctttagtagcaggcgaaacaattgaacttaatgatatctatattggctctaaaaaagagcttaaaagcagattaattataacaaaattaactgaagaaaacaaatgtaaaagaatatttaatcatattgaaggtataaaaaagaaaagattaacattgaatcaaaggagattagattttaatagcataaatgcctatattaccaatgtatctggtaatattattactatgaatcaagtacatgagttatattctttaagatggcaaatagaaataatatttaaagtgtggaaatctatatttaaaattaatcaagtgaaaaaggttaaattagagcgattcatgtgctttttatatggaagattaatagctttactactatcatctaccattgtttttacttctaaatctattattttagaagaagataagaaagagattagtgagcttaaagcttttggaaatttaactcaatactttcctaagctctcttttgagattttcaaaggagaactttacattagtagaattttaaaaagcgtattgagtaattttaaacgatttggaataaaatctaagaaaaatcataaaaaaacagcttttgatatattaaaactcattaaattagagtcttttgaattaacaagatttgcaatttaagaataatatttattcaataacctataaatttactactaaaactttataggcttttttattttgtttaaaaatacaagttttatgattttatataatttaatcttgcaattgtagtaaaaattccactctaaattttaattgatattttatgccttcttaggttgacggccatggggtatagcacaaacatcaagattgaaattaaaaatttcatttagtttttcaaataaatttaggggagtttcccagtcttgttttttactactaaatagttctttatttaaattaggcacgttaatcaatcctttcacatataaaaaaagaacatcaaattaatttgatgttcttttttaaaatttatattttattcttttattatgaaatcttcataataattttctttatttaggtaatctataagttcacgataactattgaatttcattaatatcacaaccttttaatttcatcttctgataatccagttaactttgatattaaagaaataggtaatccttcagtaatagattttttagcaaggttaatcttttcttcaattctaccttcttcttttccttctcttttagcagaatttaaagcagatgtttcatcataaattctcttttcaaactctctataacgagctatagaatctttatctaagcttattttatataattgagctttagcatttcttaatacttcatctgttgtttctaatatttttactgtttcactttcaggttcttttataaactctatccatttaagcaatgaatctatgttatctacttcattcttatctacatgtttagatttgggtagttctatgaaatgaatttcttctatatcagttaattcttcattagtagttagttctttaagtctataagtattatgataactatcgttatcaagtagcttaaagtttagtatgtttatacatatagttcttgataattcactataatctctagtagaagttaactgatctgtatatattctactccagtaatatagagttctttgaatcatgttgtattcatttttaacttgtatttctatatttataagttcacctttatctgtttttgctttaatatctaatctactaaatttaccttcattatgttctttgtttaaatcattatttagtatttctacattggctataggactatcagattttatgatagcattaagtaaggaaattaaagactctttactttcttctgaaccaaatagctttttaaaaacaaagtctatactaggtttcattaacatattaaatcactctccatagatttattattttacttatattctagcatattatcttgtctattagtatttatttgcgatatgtaaatatgatataatgtatttgttaactaattttctcacttttaaaattaatttacctaaactataacatatattcaaatttatttacagtattgatttgattttcaaaaaatgtataattaaatcatactcttatttttttacaatttgaaatgtatgtctaataactggtaatacacaaaaaggagtttcaaaatttttgaaactccttttgggtattatttatactattaggatacatttataaaaaatccatcggcattatttattatatcagaatattgaattaattgtaatattatagtatcatttattggaatacataaattaaatctctcaggtataagtaaaaaaacaaagaaagacctaaaattaggtctttctttgttttcttaaatttataaactttattggcgtggatcgttatacacgaatttattataaactatttttttgaaaatttaaataaaaaattattctataagctctattttatatgaattgaattttgaattctttgtttgagagaatttaattttaaatttttctccactcaagctctttaataaattctctatttgcccgtctgtgatttcaaaatcatccatccatgaaaatttatttactacttttccttgtaaattttcatcatatactttattttgtgtttttccaatttcaataaatctttctttaagcttttcaaagtaagtattattttcttcttttgatgatgtatctgctactcaaaatatggtcaaatatatccatatcgagattattccttcttcatagaacctcgccttgcctaagctactacgatttgatatggctctccaaaggcttaaattccgaagttagccctccgtacatatataagtgcttttgattttaagctatcttatatttcttagcatttttaagattaatacttgcgtttaaatctctatcaatagtaagtccacaatcacatctataaattctatctgatagttttaaatctttcttaacctttccacattgactacaagtctttgatgatggataaaatctatcaactattctaagctttatattattttctttacatttagacattagtttagttttaaattcaaaaaacttctgacttgcaatagctttagataaatgcttattcttcatcagattagatactgctaaatcttcaatcgttatatagcttggtttttgctttataattgaaaatactgttttatttatataatcagttcgtatattagctaatctctgatgaagtttttgtacttttactacttgtttttgaatattttgacgagtagctctcccttcttctatatttttatttctaattttcaaactttcatatttccttgaaagttttctttgttccctttttaatttcttttctacttttttgacattagaagttttatttatatttttaaatttaactccatctgaacatattgcaaaatcctttatgcctacatcaattcctatcccttcatttattgggttgaatacctgaatatcatcttcctcaactaatattgaaacatagtatctattggatttttgacttactgttccacttttaactactgaattagttggtatgtatccaaactctttaaaccttatccatccaagagtaggtattttgactctatgtctttctaaagtccaatcagttttattattcttaggaaaatatgcttttacatcttgattttttcttttcttaaatttaggaaatcccttagttccattaaagaaatctttaaatgctttatctccattcataatagcttgtttagtagctttagaagatacttctttaatccactttttatcttgattatttgggatatattcgttatttaaccactttgaaaaatccataccacttacaaactttccttctttctcataaacttctttattatgagctatataaaagttgtatataaatcttgatacaccaatagttcggtgtattttagatttttgttcatcagtaggattaatttctatcttgtatgctcttttcaacttctttatcctctctaatttttttcttatattttcttaatccatatatgcgacaactaaaaatatgaagtattgatattatatcttggactagttcttcttgtggtgaaagactttcattatttacaactataatctctacattgaatttagctaaaaaattttcaaaccaatcatatccaaaccgaataaatctatctttatgagttatgataattgtacttatctcatttgtcatacaactatcaataagtctattccattttttacgattataatttagtccacttccataatcctctaggacttcatctactattattcctttagcattagcgtattgtctaagaaattcaacttgatttttcaagtcatctttttggttagaagttgaaactcgtgtataaataactatttttctactatctttttctttatgtattcctgtatactcaagatactgttcataagtgtagtatcttctatttgtaggagttctaaacgcctttaattttccgtcattatcccatctttgcaatgtaataactgatacatttaataattctgcaaattctttaggtttataatgtttactaggtttataatgtttactaatataatcacatccttttgtgattatattataccatattagattatatttgattatatttttgttaactaaagaatatctcctccccataactttttctttaattcatcaccatatttcttcattaataaccttgctgatacaccttttaaggcttttatcatatcaggtatataatgctgtggtgagcaatttattagaagatgtatatggtctttgtctccattgcactctaatatttgaaaattattatcttcagctattttgttaattatattaattaagtcaatttcaacttcttctgttaatattggatgtctatactttacacaccatactatatgatattgtattgaataaacatatcctctaccatgagttacttccatattaatcacccatatatatattaacatatgtaatagtttaaaccaagtatttataaggtttattttatatttttaaataacatacgtaagaacggtaagttcttaactttaatcatttttgaggtctagttcactataactcgctactgttatagcagttctcttatgaacttcttatgctttcacataagcactgactatatcttatccttcgtcttaaaacgttaaggtctacccacttccactaccaatagcttgtaatgtacttccctcaaggggaatagtcgatgaagtttctccattttaaaggagcttacctgctgattgcccattattaaagcacttaggatttaaccttataccatctgatatattttttctactttcgtaacattcacacttatcttttcaggttatgttgttgttatatcagctttaggggttcccagcaattcaagtagtattggataggttatacctatctctacatacagatttctctatatgctgactattcggctactaactcatcactgaagtaacgagtttgcgtagccatttaatcaataaatatttattatttttttaaaataacttatttaaaagtaactttaacaatataattttaaatttctattaaaactatttattagtatttaaaattgttatataataaaatcatctataatttatgagagtttttttacatagatttaagcaattgttttttattcaaataaataccatccccttagatatttatttgaaattaatatctttaaagtattacttataatatagcttataacaaaaaggcatcaatatataattgatgcctttttgtggtttaaaatattgcattacagaaaaataactgaaatataattaatttttaatcattatatcatagtcctattatataagctatattaaattatttctgaattcaaagttttagcaaactctttgcagcacttctcataaacttcccaactacttgtccaattggcttttaaatatttcgtaggtattttcccataagtcttaattaaatttaatttatatttttctctttcaattttaataagtaaatcatttttatctaattcttcttttataagccatgatcttgaacctaaagctaatgcaacatagggttcttcatctattatcattaaaaaatcatcttctgttatattatatttatgtatttcatcttcagtacaaaaagccataggatgtattacttttgaacctctttctcttattactaatcttaaaaattctaacttgtccatttatattgctccaattaactaatatttaaattaaaaatagataaaatcataaaaaactttattaagtataaaattttttatataattaaattatataataaaacttacaataaaggagtaatgactattgctcctttattgtttcatataaccaataataatatttaatctcaccttttcttatatttattgaagttactctaaataactattgaatctcatgaatatcaaaactttctaatttcttctatagataagccagtctttttagatattgtttctatatcaagaacatctaaaaggcttttagcaagttttttcttaacttttagcttaccttcttttctaccaatttcaatcccttctgctttaccttctcttttagcagaatttaaagcagatatttcatcatacattgttttttcacataaatcataagtatttttgaatgttgaatttaaacatactttataaaagtatgtttttaatcctcggatattattatcttcttctaatattctagttagatagctttcaggatacttaaaaaatatcaaccattttgataaagaatccatattatctaatgagctatcatctaatagctcattattagatttgttaaatttactaaactctataaagtgaagttcatctatcatatttttagacttattgtttaattcatatattgaatgatatttttcaccatttaaaaatgtagaatttaaaaatgttatacatattgaattattgttaaaattagtttctttaatagttttaaattcattttctttaaaaaagtttaatgtattatctaaagtaagcatactattaactatttgaattgtaatatacttcttaataccattactaaaatagcatatagtgtctattctgtgattattttcacataagcatttagtatgcttagtattatccaataataagtctaaatctataatcttttcattacaatttaaaatagaatttagaaaatcaattaaagcatttttactctcagttcttttgaataattttacaaaaacataaggtatagttaaattaattgtcataatattttcacctcaaaagttaatcttttataatttcttcaactaaattttcatctaattctaatattttagctatttcttttaactctaagcctttacttaataagtttttagctattttacgattagcttttagttttcctcttacttccccttcttttaacccttcttcttttccttcttttctacctatcttaacaccttcttgtagtcctttttctcttgagttttctaaggcagatatttcatcatacatagctttttctcttattctatattgctctattgttttcttatccaaacttaacttatatagttgagttttagcttttcttatactttcatctgttaactctagtattcttacagtttcactttcaggctcttttataaattctatccatttaagaagtgaatctatattattaacttcttcagatttaatttcttttgatttaggtaattctatgaaatgtatttcttctatatcagttagttcttcattagtagttatttctttaagtctataagtattatgatatctatcattatctagtagcttaaaatttaatatatttatacatactgttcttgcaagatttttatagttttcagatgctcctaattgatctgaatatattttactccagtagtataaagttctttgtaccatattgtactcatcacgtacttgtatttctacatttataatctcacctttatctgttttagctttgatatctaatctacagaatttatctcctatatgttgtttttctaaatcaggactttttaattctatatcttttattgggttatcagattttataatagcattaagcaatgatattaatgaatccttactttcttcagctccaaataatcttttaaatacgaaatccatactaggtttcattaacatttaaatcactctccatagatttattattttacttatattctagcatattatattgtttattagtatttatttccttgctggaagtatgtcataatttaaatagtctattgttagctaatttcacacttttaaaattaagaaaacacaaaagtcagcaatattatgttattgctgacttttgtgttttctatttaaaaatttaattaacttcatatatatctgataattcaacagatatattatgagaactttcatatttataatttctttgctttttatcttttattattttatttggtaatgaaatttcaaaaatacttcctttacccaattcactttctacacgtatatctccattaagaatatctaacatagacttaactatacttaatccaagtccacacccctcatttaaccttgtgaaagaagtatctgctctaatgaatctatcaaatatatgtttctgagtttctaaatctattccaaaaccttcatcttttatagaaattttagttacagacttttcaactgatatataaacatgaatagtagtattcattttagaatactttattgcatttgataaaatatttaataaaattttttcaatcataattggatcacacattatataatgttcttctacatttgtatcaaactctaaaaacaagttttttgataatgcaaatggaattatagagtttgatatatcttcaactaataaaatgatattataatttccatagtcaggttttaaaactcctaaatccattctagataagtctacaatattatttactaatctaatcattcttttgcagttcaattttaatgaattactatgtttattaaatgcttctttaaaattaatattttcattttgactaaatttttctaataattgtatagttgaataaaaaatattaagtggtgtttttaattcatgtgatatatttgataaaaattcatctttttgtaaatctctaaatttaatattttctaaagttttttctagttctagcgtactactaatatctacataactcactaaaacttcattattatttaaactttgaacatagcaatctaaaatttcattagtttcatggtctttaataattccactccaatatccttgattctctaaatcaataaaaatatcttttaatttataagaaagatgtttattatttaataaatcatttttaaatttagttttttcttcttgaaaggaataatattctttaatttttttattcacataaaaaatattaaaatcataatcacaaataaacatattactatgcttattattttcaacaaaattaaaaaatttaattaattcgttgtttaatgaattataattaataattgttgaatataatttaactccagtagcaattattattgttataaaaaacaatgaggttatagatacagatataagcttaatatcaaaacttatataaaaaaatccgtaaatagcatatatagcttttaaagctaataagattatacttgcactaaaatattttaaaataaagtattttgatttagataactttaataattttatagaagtatataaatatattgctattaaaaaaatattatataatataaaaaaatattttttatttgctaggatattttgaaatttaaatatattctcagaaattccgaaaattaaagaataagttataacaaatataattgcttttttagaatttttatatatggggtatcgtccatggccgtcaacctaagaagccttattttctataataatgtataatatttaattaattattacagaaagtgaggctttaattttatgaacaaaaaactcaaatatttatctaaaagcataaaagaaagttttgatattaatgaaataaacaaaatagcaaaagatacaaaattcattcaaagaaaaggcagtataacagctaaatattttttgatgtttaatgtattttatggctcagatatctgtatagctccgttatcacaactagtttcaaaatatgatatgttattttctaagcagctatctaaacaagcattagataaacgttttaataaacactcagttgaatttatgaaagaaatatttgttaagtttttatattctcaaaataatacattaactaacttagaacgtactttaagaacatattttgatagagtcataataaatgattctacaagttttactttacctaaagagtttaaaaagaagtttccgggttccggaggagtcgcttctccatcatcaataaaagtacagttgcaatatgagttgttaaccggttcatttatgaatatagatatattttcaggcataaaaaatgatgttgagtatttgaaaacaatgaaaaaatataaagattataaagacttaaaattagctgatttagggtattttaaaattgattatttaaaaaggcttgataaaagtgggacatcttttatatcgaaagtaaaaagcaatacctcattatatataaaaaatccaaatcctgaaaaatataaagttggaactataaaaaagtctagtgagtatataaaaatagatatcattaagttagcagagcctttagtagcaggcgaaacaattgaacttaatgatatctatattggctctaaaaaagagcttaaaagcagattaattataacaaaattaactgaagaaaacaaatgtaaaagaatatttaatcatattgaaggtataaaaaagaaaagattaacattgaatcaaaggagattagattttaatagcataaatgcctatattaccaatgtatctggtaatattattactatgaatcaagtacatgagttatattctttaagatggcaaatagaaataatatttaaagtgtggaaatctatatttaaaattaatcaagtgaaaaaggttaaattagagcgattcatgtgctttttatatggaagattaatagctttactactatcatctaccattgtttttacttctaaatctattattttagaagaagataagaaagagattagtgagcttaaagcttttggaaatttaactcaatactttcctaagctctcttttgagattttcaaaggagaactttacattagtagaattttaaaaagcgtattgagtaattttaaacgatttggaataaaatctaagaaaaatcataaaaaaacagcttttgatatattaaaactcattaaattagagtcttttgaattaacaagatttgcaatttaagaataatatttattcaataacctataaatttactactaaaactttataggcttttttatcttgtttaaaaatacaagttttatgattttatataatttaatcttgcaattgtagtaaaaattccactctaaattttaattgatattttatgccttcttaggttgacggccatggacgctaccccaattaataaaaatctattagtaattggagtttcactattttcttcgcctatcattatctcagcaatttcatcaaaacaagtacaaaaataattttgagaattatacttaactaaatattttttgttgttctccattttagttcatccttccttattatcttgttcataatgattagtattgaaattttattaaaaggttcaaaaactttgctttttactattatcaacctaagaagtataaaatgttatgattctgaactatttatcagcgttattaaactttagcttattctaaaagaaaagagcatcgattttctagatgctcttaatgtggtttaatacttcaatcttgagattaattttaactttattaaaatttgatttaatttatatttcctttagttaattgtaaagtaccatcttctaaagttgtaacactaattctttttccatttacagctttatcactttcgaaattatattgttttgatgatgactttataaaaccttcatattgtgtatcattagtgaaacctgatacctttattttataagtaccatcttctagttgtgctaaaacatttgtaggaactactaattggaatttactaaatttactatcagcaacatttcctattttaataggtgctattccagcaacaggttgattagtattagcatctattattactgctgttttagcaaattgtttatctgcagttacatctatatcaaaattaccatctacaataaagttgttagactttttattgaaataagtatttctaattcctacattagcttctttaacttgtaatggagacttagttataactaaatcttctcctttaatagcatctacgctaacaactttatcaccaagtgaatttgaaacatcaattttttcaggaattgatccaagcgtagctacatattttttaccattaacttctgctcttaatgctattttataagaaccttctcctaatttgtctagcatatctttctttattcctatttggaacttattaaatttaggatcatctttaaagttttgagttgttaccttaattccaggtatttcttctcctgtttgactatctattaaagtagcatattttttaaatgtagctagttctaatttactttctgtgaaagtagcattaatatataagtcacctttagcattaaagtataccttcattgcacctgattttgctggaatttcctcaacttgagcagctttaacaataacttgtctagttaaagtagtctcatttccagcagcatctcttgcagtatatgttactgtatattttcctggtgtatctaattttacatttgatgaatctactgtaacttctactgatccatcaacatcatctgttgctgttactccagctgagaaatcatatgattcacctgcagttatttctattggtgtatttgctggatcttctactccatcaactgttatcactggttttgtttcatcaactaatattatattttgagttactgttcctgaaaaattcacagtagtatttcctatagctatatcttgattaaaattataagatttatttccagtttcagttatattattaaaaataatcttatttccttcagaatcatatgtataatcagcattttctacaggagcaagataattaccatcttttcctactattatattgtttacttctgctgtatctcctttagagtaaacttcttcagaagaaacttcttgataattaatatatgaattagataaattagttaaattagctattggactaacatcgcttattctattattttgaagccataaagtttgcaaattagttaaattagctaatgggctaatatcacttatttgattatgcttagcatataaatgttttaagttagttaaattagctaatgggctaatatcacttatttgatttccatatttatcatatcctaaatctaaattttctaaatttattaaattagctaatggactaatatcacttatttgatttccatgtaatatcaactcatttatagaagtacaattttctaatcctgttatatcacttatatttttattatttaagtctaatgtacctgttaatgaatttaattctgaaacccaaatattccaatctggttctctatttttattttgaatttctgaaagtttttcatttaacgcagcttttaaatttgcatctggtatattagcttgaacttgatctgcatcagttcttgtaaaagattttgaagaagttgagtacctataatctaaaacattgatagtatcaagatttgttactcttactttatctccatcagctaaagtaagaccttgtaatccttcaaatgctgaatatagtttttctcctctagcacaagtatatgtttttccttgtaattctatttttaaattattcttagctgttgtattaggatcaatatctaaaaatggcatatttgtatttcctaccatttttatagttaactgatcttcaatatttaaagttgattttacttcattatcaaagttagatacatcttctgttcttaattgaccatcagctagaacccttaagcctacaaatgggttattttcagtacctggttgaacatactttgaataattaaatctttgtgtatacacagctttatcaaaattcaatgtattttcagttaataaagttccttttgggaaataaaaattagctttatctacttgatatctttgatatacatgccatttattatcataccactgatgaatacttattttatcagaagctttatctactccatcagtaaaagtattattaattcctgaacccgcaacaatccaatcattaggaccattaattcctaatgcatatatcttatattgtactaaaaaatcattactatctgttccagttaatctttttccatttccatttattttcatatgcaaagtattatcatcttgaattctaagagtcaaattttgttctgaaccataatatgcattttttacagagaatatagtttgagcttcattattaagaaatttcccagtatttgttacactattccctggattactccatcttacttctttagttactgatggtatttcttcattagatttattctcattattaacactttcttcaacttgttttggtgtttcatctacagttgctgcaaatgcttgaagagaaggtgataccatactaaccgttaatgttccagttaatataagcgcctgtaatttttttctattcatatatttaatacctccatttgttattttcatatatatagttattctttttaataaaaaagttcaaaatttctaatttaatattttttttaacttaacttcttctgttctttttatctctttgcaagataccttttgatgcttatgtggagtttttacccaaactccttgttttttccattttattagcccaaataattgagtaattgcatatgtagatccaaaatataatgtacctataataaattttatataattaacttttttcttatcttttttaaaagcataaattggtaaaattagataagaatatatagatattagtatatttatagtagttaacggaattataaagttttttactaaagaaatatttattgctataaacattccagcatctattctatttattaagaaataaataaatattatagatattgaaattaataatagtaacaattgtattcccttgcctaaaccaaataaatataataactgatcaaaaactttaaatttttcttttatatttccttttaaaaacattttaaacaagcttttaaaattcttaaaagcaacaaaccaatgtccctgagaccatctagttctctggcgaatactaatttttatattatcaggtttttcatcataaattccaactaaatggttccataaaattctaccaccattttctactatatttatttgagtttctaaatcatccgtaagtgatttacaaagaaaaccatttgcttttattaagtaatccaaacgaattataaaacctgttcctcctaagcaactaggtaatcccattttatatttagctaattgaaaaaatctatttgtaatccaataagaagtagcatacccacatgataaaaaacttttactatttttggcccctaaataactttgtatagcttctggtttccccttagatatccattgagaatttaattctttaagaatatttctatcaacatgattatcagcatctaaaaccatgagaacatcatatttatctaaaagtttctcaaaacctaaatatcttaatgcatattgcaatcctcctggtttaccaactccttctcttggataaagattttctaaagtatcaatatgtttaatccctaatttatcacatacttcccctgtagaatctgttgagttatcatttactatataaatatcaaataaatctggattataatttatttcccttaagttgtttacagtattttctataacactttcttcattatgagctgcaactaaaattaaaaatctagttttatcctcaattaattcataatctctttttacttttccaaacccccaaaatgaaataaatattgtatataagttttgaaataacatataaaatccactagatataaaaattatagtgaatatatagaaaaaataattcaatacatctatcatctaaatttctccaaacttttaattattcattaaatttagtatcgttactaatttaaaagttcaaaaaagttttgaaaaaataatagtagtattctttatcaaagaatactactactatttttaattaagtttattttgttcttttaattcattatttaatttatcaattgatcttgataaataaattaattcatcagttaatccgctttttaaatacatacgttttattatatcttctatgtcttttgaaatgtttgaataaatattgtccactttaatccctctcaatttatgataatatttatattgctattagttcttttaaaagtaattttttctctaaatcttttttacaagaaaataatctacttttaacagtaccaacaggaatattttcaatttttgcaatttgttttaatgataaattattaaaataatacataattaaaactcttttctttttttcatttaatttacttatttcattaagcaaaactgtattcaattctttatttaataatgatttttcaggaattatatttttattttcactttctaaaaactcaagaatatcattattgctgcttttttctttttcagatattatcttttttattctacaattaattttatttaatgcaattttcattaaccaactattaaaaaattctacattttttaacttacaaatacaattaaagacatcaatgaatacttcttgagttatttcttctgcatgatattcatcttttaacattttcaatgaaaagaaaaatactttattatagtacttttcaaatattaaattaaaattttccatattgttattcctaagttgctctaaaatttctttttcgttaaagttaatcataattcatcaaacctcaattctatccgtattaaacttttgttcgttaataacggttaaatagaatttataaaggttcaaaaaaaaagacataattaacaaataattattatttataattatttgttattatttttaacaaataattaatagcaaaagtgtttttaaataaatttgattgataaaatattataaaaattttcaatattagataagaaattataaaaatgaacttttttttgattttattaacaataataaatgaaattaatattggaatggagatggtgttttggatgaagatttaattttacaagtatattatcaacctaaagttaatttaaaatctaatgaaatatatggagttgaggctttagcacgttttagcaattcaataggtgagatttttaatacagatgaagttttaaaaaattttaaaagtgaaaaagaaataatatctttaagcactctggttataaacaatgttcttaatgattttaataataatgataatataaaaaaaggatttaatgtttctgtaaatatatctgctatagaaattgaaaatttaaactttcaaaattggtttagaaatgaagtattaaataatatacatattaaaaacaattttgaattcgaatttgaattaaccgaacaatataaaataaaaagtgaagatgtttttttgataggcttgaatatttgagaaatagtggtattaaattatcgattgatgatttaggaaaggggtttaacaataaagatttaatatataaatataagtttgatttagttaaattagataagtcttttatttctttagctaaaaaaaatcggaatattgtaagaaatttaattgatgaaataaaaaatttaaatttaagagtgcttattgaagggattgaaagacaagatgaattagaaatagcaaagtctttaaattgtgattttgcgcaaggtttttacttaggaaagccatgttgtttaaaagattttttattattggggtagcgtccatggccgtcaacctaagaagccttattttctataataatgtataatatttaattaattattacagaaagtgaggctttaattttatgaacaaaaaactcaaatatttatctaaaagcataaaagaaagttttgatattaatgaaataaacaaaatagcaaaagatacaaaattcattcaaagaaaaggaaatataacagctaaagattttttgatgtttaatgtattctatggctccgacatatgtactgcttctttatctcaactagtttcaaaatatgatatgctattttccaagcagctatctaaacaagctttagataagcgttttaataaacactcaattgaatttatgaaagaaatatttattaaatttttatatgctcaaaataatacattaactaacttagaacgtactttaagaacatattttgatagagtcattataaatgattctacaagttttactttacctaaagagtttaaaaagaagtttccgggttccggaggagtcgcttctccatcatcaataaaagtacagttgcaatatgagttgttaactggttcatttatgaatatagatatattctcaggcataaaaaatgatgttgagtatttgaaaacaatgaaaaaatataaagattacaaagacttaaaattagctgatttaggatattttaaaattgattatttaaaaagacttgataaaagtgggacagcttttatatcgaaagtaaaaagcaatacctcattatatataaaaaatccaaatcctgaaaaatataaggttggaactataaaaaagtctagtgagtatataaaaatagatatcattaagctagtagagccgttagcacctggcgaaacaattgagcttaatgatatctatattggctctaaaaaagagcttaaaagcagattaattataacaaaattaactgaagaaaacaaatctaaaagaatatttaatcatattgaaggtataaaaaagaaaagattaacattgaatcaaaggagattagattttaatagcataaatgcctatattaccaatatatctagtgatattattactatgaatgaagtacatgagctatattcattaagatggcaaatagaaataatattcaaagtttggaaatctatatttaaaattaatcaagtaaaaaaagttaaattagaaaggtttatgtgctttttatatggaagattaatagctttactactatcatctaccattgtttttacatctaaatctattattttagaagaagataagaaagaaattagtgagcttaaagctttcgggaatttaattcaatactttcctaagctctcctctgagattttcaaaggagaattttacattagtagaattttaaaaagcgtattgagtaattttaaacgatttggaataaaatctaataaaaataataataaaacagcttttgatatattaaaactcattaaattagagtcttttgaattaacaagatttgcaatttaagaataatatttattcaataacctataaatttactactaaaactttatgggcttttttatcttgtttaaaaatacaagttttatgatttaatataatttaatcttgcaatttaatgcaattgtagtaaaaattccactctaaattttaattgatattttatgccttcttaggttgacggccatggacgatacccctattataatttgttttttttcataagacttaactttattataagaatagcttactttaataataaaaaaatagcatttctaaataaaataaaaagtgaaatttcgtgttaatatatacgcaattccacttttttattattctattttactgattttaattttgcaatatctttgtaattattagccgtaactaattcaacagttgataaatcatctcttattccatcaactttatttaatagctcacatctaaattctactaaatcagcagtttgttctactactccatcaagttttttattaataatattaatttcatcttttaactcactttgacctctttcaatatttgaaagtttagtattaatattttttaatagttctaataattctttttccattaataataactcctttgcatttactttaagttttagtttacttttatattatatcataaaaggacacctttaaagatgtccttttaaagcaaagtttctaatggaaattttgcaaactaaaacttaaattaattctaacatttattcatttaattctcaatatacatgagtattattaggaaatagaatacaactattaaaaatcaatctatctatctattacttgttttgtagcttctatccttctatctgcaaaaataacaacatcccttattaccaacttttgaatggctgatattaatgtttcaatatattcaaaatcaatttcattatctttaactttaacaaatattctttgtttattaattgctttttcactaaaactagatgcaccccaagaaaaggaactaaatgattttgacattgtaccaataaagtattgagcagaatatttattaaaatttttaaattttgactttaatattttaattttatctccagtaaaatatggattttcttgataaaacatagttgcagtgtcttgtccaaaagatatagtatttccttcatttaagtaatttatatcctcgtttaaatatccctttattccattattatttgaagttcttactacatatgggtaacctttagtaagtatgtctaccttattagcatcaaatcttttcttagaagaagatacattaaaaatatcacttacttttaactctattaagtttattcgtccattttcataatcttctacagcttgtttttctttatctgttaattcataatctttaagtcctgtagctaatagataagcctcaagctctgcaacacgctgagcctcaagctctgcaacaaaagactccataaattcaaagtctatttcgccgttttttattggaagttgtatatattcatctttaatttttgcccaagaacacatattttcataaccgaattttgaatttaaaaagtgaaatgcgcttacaataaatatacctgtacgctctgtaagttttaattttgattttaaagaaaaaactcttgcatgagtaaccattttgtacttaaatactctataaaaagcatatccaaacatgtctacagtaattgtattttcttcaaaaatcttagctgcaatatctgttttccccataataccattttcttttactcctgcagttatgacatattcacctttaccatttatgtgattcttttgaatatcaaaatcaccgttactactaacaaataagtctcctagtctatattcgccccactgaacattttctaactttttattcagtgaggcatctattttcccaagctatcattatccttgttttgcccttttaatatatttgatacttcccaagctaaataatcagatacagttttcttaaaatcctctaatttaggttttgtatctattggtgctgattgattccagtctgctccattttcaggatcaatagttccttcatagtattctttttctgtaaatatgttcaatttactcttaccataacgaacaagatcaactacttcttgatatctttctttcgccctatcagtatctcttaaattattactagctttttttctatttgttcttgtatatccatcattagaaaagtctataaatttaacaatctcatctttttgatgtggttcagccactctaaatacataaatatttgtttgcacacttgattttccaataaataaatcaataggcattttaatgctagctaataaagtattattttttaatattctcttattatattctattgctttgcctgaaccagctgaattttgaataataatagaagcatatcctttttccatcattgaaagtgctttttctacaaataccataccattaccatctgctgaataaggtggatttaatataaaagctgttgctggaaatttttcatctgttttaccaaatccataatttccattaaagtcatttaatgagtctctatttaaaatattagaacttccatctcccattaaaatcatattaagtattgctaacatataaatacttgataatacttctaagcctaataattgctcagcttttatcttgagattcttttgttctagttcctcaggtgatttaattttttctttagcatctattagcatttcattcattgcagcaacaagaagtccagctgaacctgttgcaaaatcccatacataagaatctttattaactcttgcaagctttactaacagagttgctacatatgaaggagtaagaacaacatcatttaacttatcttgtgtaaatccaagccaagaatacatttcattaaataatttccctgtaaaatctgttgtaagaccaatcttgtaataaatccctaaatcatcaactatctttgaaaaaactctttttaactgactttctccatttgttaccttattgatattatctgttaacagtgtattttttaatgttcttactattaaatctttttttgctggtggtaaatccttataacttaaaaaagattctatctttctaacgataatatctccatcacgttcacctaattctgttttagattttaaatctgatttttctaaaggacttacacttccagggatacctaatgttgcaataatggatgctgcaactaaatatactctatcattttctcctaatcccttttcattcttgtaaatatcattatttaatgctactagacttgcatttatttctttttctcttttctcttttaatctttctatttcttcagcacttaaagagagttccttaacggtctttatgaaatcatcaaagttttctttttttaagaaagaaagatccgtatattctccaacttcttgacctaaaccaaaattatcttttgatacatagtaaacaccaatagaatgctctaatttcccaactgcatttttacaaccagtaacacctattgctattacatcagtataacttgtataatgtaaaattgcatttgcataatgtactgcaccattaactgcataagaattgatatttttatagttaggttcatttttagtagttttattatctacctgcccattaatatctaactttactaatttgtctttatatcctttgtattcaataagaataggataataatttaaatttttatcttgtattaatagttttgcatcaggtctatttccaccttttcctccgctcttagaagaatactcatttaaagctttatcaatttcgctatttaagttttcttgttccaatttataatctaaaccatatttttttagccaaccatttactaaatcagctatatttggctctacggatttaatactttgttttttagccacttttttatcctcgctttctaaaatacaaattcacaaacatgttctagtttaacattaaaatatgaataataacaataaaaatgtaaaatcttataaaatttattaatccaaaattttatataaattaatataaagctatctttagaatatagaagaaatttgaaaattatatattaatgaattcctgataaatcaatatttatttgggatgagtctagcttataattaaaagctctaaaatttttatctttaatatcatttataataaactcttttaatatattttcatcagtatattggaagtttgtatttatttttgtaggagttaattatattgttaatataaactccttcaaattatttttaactatattatctaagaatattgatgaaaaatttatatcattatattcttaatttaaatctaaaagatatttgcatgatgggattctgtcaaataaattttttatttcagttttaccagtatcccatttaatacatatcaactacattaatataatttaatatagttttataattttcatcataacatattaataaatagtccttagtattatctttaattttactggcatattttttagcaatgttaacttctttactttcaattctttttaaattatacataatatcaatacctcatatatcaaaatttaagaagcttcaaaggttttaaccatctcataaaaaacagttttctttaatcctaagatttccatacttttctttgcagttaactctccttttttccatttagtatatatttcttcaaaatttgatggcatttcaattttaggtctacctaattttttacctttctttttagcaagttctagcccttctctttggcgttcttttattctttttaattcttcttctgcactaattaactcccaatcaactaaaaaattaatcatgaatttactcattgtatcatttaacttatataagtcctccagcataggtctatttagaacataaacctttacccctttagcaattagctctgtaaactctttccttccttctaaataatttcttccaaatctatctaaagaagaaactataatattatcaccttcagtaactatcttttttaataattgataatttggtctttcaaaagtttttccactaatctgatctgcaagtattataacttctttttctcctattcccattctcttacaaaaagaatccaattcaggattttcttcttgtctatccaatttctgacttttacttgaaactcttacataataaaaccatctattcatacacttctcctaatttataacaaaatatcgccgtaaatattatatcatatttacggcgatatccgtttaaatttgttgtgtttttagaactgattttcgatatttttatcactttccgtaaaagttaactttttagaactgtatagtcatatataaatatttattatttataaaaacaacttatttaaaagtaatttttataatataatttgaattttctattaaaactatttattgatattttaaattattgtacaataaaatagtctataatttatgaaagtttttttacatatatttaattaattttttattcaaataaatacttccccttatatatttatttgaaattaatatctttaaagcttgtttaaagtgttactctcgtaaaataacttataacaaaaaggcatcaattatatattgatgcctttttgtggtttaaaatattgaattacagaaaaataactgaaatataattaatttttatcattatatcatagtattattatgtaaagctatattaggggtctcgtccggaaaatgcggatttacaacgttaagagaaattaagctagtattttcaatggtttgcagacttttgtataaattttactttttatcaaatttatcaaaaatagaaagtttaaattattttcaagacaagtcttatgggactgcctaaaaccttgatttatcttgttttcaaaggtgtatcaatagggtttaccctatcgataccaaaatacaaatattggcttagcgttgtaaatccgcattttccggatgctaccccatggccgtcaacctaagaagccttattttctataataatgtataatatttaattaattattacagaaagtgaggctttaattttatgaacaaaaaactcaaatatttatctaaaagcataaaagaaagttttgatattaatgaaataaacaaaatagcaaaagatacaaaattcattcaaagaaaaggaaatataacagctaaagattttttgatgtttaatgtattctatggctccgacatatgtactgcttctttatctcaactagtttcaaaatatgatatgctattttccaagcagctatctaaacaagctttagataagcgttttaataaacactcaattgaatttatgaaagaaatatttattaaatttttatatgctcaaaataatacattaactaacttagaacgtactttaagaacatattttgatagagtcattataaatgattctacaagttttactttacctaaagagtttaaaaagaagtttccgggttccggaggagtcgcttctccatcatcaataaaagtacagttgcaatatgagttgttaactggttcatttatgaatatagatatattctcaggcataaaaaatgatgttgagtatttgaaaacaatgaaaaaatataaagattacaaagacttaaaattagctgatttaggatattttaaaattgattatttaaaaagacttgataaaagtgggacagcttttatatcgaaagtaaaaagcaatacctcattatatataaaaaatccaaatcctgaaaaatataaggttggaactataaaaaagtctagtgagtatataaaaatagatatcattaagctagtagagccgttagcacctggcgaaacaattgagcttaatgatatctatattggctctaaaaaagagcttaaaagcagattaattataacaaaattaactgaagaaaacaaatctaaaagaatatttaatcatattgaaggtataaaaaagaaaagattaacattgaatcaaaggagattagattttaatagcataaatgcctatattaccaatatatctagtgatattattactatgaatgaagtacatgagctatattcattaagatggcaaatagaaataatattcaaagtttggaaatctatatttaaaattaatcaagtaaaaaaagttaaattagaaaggtttatgtgctttttatatggaagattaatagctttactactatcatctaccattgtttttacatctaaatctattattttagaagaagataagaaagaaattagtgagcttaaagctttcgggaatttaattcaatactttcctaagctctcctttgagattttcaaaggagaattttacattagtagaattttaaaaagcgtattgagtaattttaaacgatttggaataaaatctaataaaaataataataaaacagcttttgatatattaaaactcattaaattagagtcttttgaattaacaagatttgcaatttaagaataatatttattcaataacctataaatttactactaaaactttatgggcttttttatcttgtttaaaaatacaagttttatgatttaatataatttaatcttgcaatttaatgcaattgtagtaaaaattccactctaaattttaattgatattttatgccttcttaggttgacggccatggatgctacccctattaaattatttctgaatttaaagttttagcaaattctttgcaacaattttcataaacttcccaactgcttgtccaattgtctcttaaatattttgtaggtatttttccataagtcttaattaaatttaatttatatttttctctttcaattttattaagtaaatccctttcatctagttcttcttttataagccatgatattgaacctaaagctaatgcaacatatggttcttcgtctattatcattaaaaaatcatcttcttttatattatatttatgtatttcatcttcagtacaaaaagccataggatgtattgattttgaacttctttctcttattactaatcttaaaaattctaacttgtccatttatattactccaactaactaatatttaaatttaaaatatataaaatcataaaaaaactttattaagtaggaaaaattttatataatgaaatcacctacttaatttagatatttttactatttaaaaaaagtttgtctccaattatatacattattaactaagtatttatttacaatttcaaaatagtttaaatatctaaattccataataaaacttacaataaaggagcaattactattgctcctttattgtttcatatagccaataataatatttaatttctccttttcttatattcattgaagttattccaaaagaaaatatcttccctttaagttttaaatcaaataaattattaggttctgtattttcatcttctacaaatgtatctttattaagataaataaagttctctatttcttttattatgaaatcttcataataattttctttatttaggtaatctataagttcacaataactattgaatttcatcaatatcacaaccttttaatttcttcttcagataatccagttaactctgaaattagagaaataggtaatccctttgaaatagattttttagcaagactaattttttcttcaactctaccttctcttttggcagaatttaaagcagatgtttcatcatacattctcttctcaaattctctataacgagctatagaatctttatctaagcttattttatatagttgagctttagcatttcttaatacttcatctgttgtttctaatatctttactgtttcactttcaggctcttttataaattctatccatttaagcaatgaatctatattatttacttcatctttatctacatgtttagactttggtagttctataaaatgaatttcttctatatcggttaattcttcattagtatttacttctttaagtctataagtattatggtaactctcattatctagtagtttgaagtttaggatgtttatacatatagttcttactaattcactataatctctagtagagcttagctgatctgtatatattctactccagtaatataaagttctttgaatcatattgtattcatttttaacttgtatctctatatttataagttcacctttatctgttttagctttaatatctaatctgctaaacttaccttcattatgttctttgtttaaatcgttatttaatatttctacgtcttgtatagggctatcagattttatgatagcgttaagcaaagatattaaagactctttactttcttcagctccaaagagctttttaaatacaaagtctatactaggcttcattaacatattaaatcactctccatagatttattatttacttatattctagcatattctcttgtttattagtatttatttgtgatatatacatatgatataatgtatttgttatctattatttaattaattttccacttttaaaattaagaaacacaaaaaaggtatctataaattttcattgataccttttttgtgtttttaatatgtcaaatgtgcattataaaaaattaattcacctaaattataacatatattcaaatttatttacagtattgatttgattttcaaaaaatgtataattaaatcatactcttattttttataaatttacaatgtatgtctaataattaatagtacgcaaaaggagtttcaaaatttttgaaactccttttgcatatatttatactattaggatatattatataaaaaatctataggcattgtttattatatcagaatattgaaataattagaatattatagtattatttgaataagcaatttatatctttatagtatagtcaatttgagtaaaaacaaagaaagacctaaaattaggtctttctttgttttcattaaaattataaagtttaatggcgtggataattatatccaaatttattataaactattttttgtgaattttaaacctaaaagttattctataagctctattttatatgaattgaattttgaattctttgtttgtgaaaatttgattttaaatttttctccactcaaactctttaataaattctctatttgaccatctgttatttcaaaatcatctatccatgaaaatttatttactacttttccatttaaattttcatcatatactttattttgtgtttttccaatttcaataaatctttctttaagcttttcaaagtaagtattattttcatcttttgatgatgtatcttctataatttctttattagttgcagctatattattttcttgaagtttttttatttccatatttaaattttctatcttcgaatctttaaaagacaatttagtctgcataaaaataataattatggttagaatcactattgttaccattgaaattttattttttaaaatcttttcttttattaattgaatcatgtttgaatcctttctaaataaaaaagctcatcattaattgatgaacttttttattttttaatattattttatggttattctacaaattttatatttaaatataaaatttaatcacatcctcattttaggcactatctttgtttctgtaacttctttttctatttcaatagttttttctttccttaatggaacaagctctatatcattatcatcacaccagcttattaaatctatatatgtgtaactatctatttctttctctattttagatattttttcttctataacttctacatctccaagttcaggaactttataatctactatatactctttaaattcatctaaactctttattactttattatgttctggactttcttgtgataatatttctattccattctctaaacaaactgaaaatatatcattcatatgtttttgaaaatctactttattctctttaagctcaaagcctatctttttatctatattagttttacttaatatatctaactggttatttaaagtgtctgctaattcttttgaataattcatgtataattgagtttctaaagaatgaaatccatctattacattatctttttcatttatataatcttcaattctatttaagcaatcataatagtttttgatattattataaattataggaattgattttttatttaatacatctaaaaataaatcctcattgctatttgctagttcattcattgattttgaaaaagctttctctagtctagtaacttcctctatactttgcttatctaaatttatatctaaatttaatgttgctcttgtaggctctattcctatttttctataatctgaatttgatatatagaaattatgtttattttggttctcaatattattttcaggttctattccaaacatatcagccaacctataaattgcctcctttgcattaattttttctacttctgatacaaattttataacatctccacctgtagatgaaccaaaatcataccagtaatttttatcagtatttatacaacaagaaggggttttctcccctctaatatcacaccacaattttttacctttaggagatgtatgaactcctaatctattgcatacatcttctaaaggtatttcttttattttatctaaattataaaatggttgtacttccttttctactaattttttagaattgagctcttttttattgtaatcttctttaggtttatcaattctattttctatattatcaactgtagctgacctattgttgtaattgtttttaatgtttcttttttcttcaaactctttcttagttactccactacttgaatcagcaaatagttctaaatctaattcatctatataatattttcttgaatcatgttcaaaatagcatttatcactactttcaaaaactatattatagccgtaattatcttttgatataacaaaaaaagatgtaccactcttaatgaatgatccatcttctaaattataatcttcctttgttttatatattttttttacttcaaacatattgcattcttcagaatcgtagttaccttctaagtcaagcatttgtccaaattctactggtttatctaaattagcaaatttactaaatgcctcaatattttcttctttacctaaccaagtaaatggcatcccttcaatagttactgtttttctccattcattataaatcttttgtaaatcatactctctcataatatctcctccaaatttataatattaaatcttgtaatgctaattcatagggttctataatatcctcataaactatggtattactatcatcaattatgttagaaacattcagaattatttcattaggtttatttattttatcttcagctttataactactccaaagatgttgattataacaatgatctttttctttttcataggatataaaataaaacttatgtttatcaaacacataatgaaattttaaagtacaaactggtttatcttttgtcatttttgtatgaattgggaaaactaaagttacatatttatctttaatacctatctttaagcttaatagcataggagcttgttcatttaacttcataacatatgggtagcctattttactaactttacgcccatattttttagatattgtttgataatatttatttctataacgattatttattttataatctttaaattcttccatacctaatgaaaaatcaaaagttaatccattatagtttgaatatggaaaataacaaccgaagtcaaaaactatacaacattcatcttcagataactgaatttcattctttaatatttcactaaaatgcgtcattttatcatcaccttttacttttctaaaacatatatcttactaataaaatacaaggataaataactagaatttatccttgtattttaggtactttacaatagcaaaattatgattaaataaaaaataaagttatacattattttctttggttaatgtataacttatttcatattcatctaactcttttaataattcatctcttgatttaatttccattgcagctattaaatcatttaacaactcattcttatccatgctcttattcaccttctaaaattattccttgattttatttatataaaaatgctttactatccataacactaatacaattaaaagtattctattagaattaataccagcattaattctaaattcccataatcccataagaaaaaatggtatgattagtgagcctataatactaataattaaaaaatttattgttttaattattaattgtttgtaatttatatttcttaatatatctttatttgaattgtatttgtcagaataaagaattttaataaatgaaattaaaaattttaaaatataaaatataaaaaacaatacaaaaatcatattagatagtgaataataacctatattacttttaaaaaattcatatgcttcatatagattatccataattaagcctcatctgtaacttctattgcaatataagaacaactctgagctggcttattatcagttacatcaaatcgctctaaattatttagcataatatcattaaactcttctctctctatattttcaggttcgaaaattactctccttacttctatgtcttttgtataactatgaatctccatagcaattctacagttactcattattacattcattgtaggactgaaatcaaaagtttgatcttctttaaacttctctttatcgaatgaacagtagaataaatcacataaataacattcttcaccgttttttaattttaatgtttgctcttttaactcttcttcttctgtttcaaataaaatttcattgccatcaatatcataaattttaaatagaaccattatgctagttccacctattagctcacctttatatttaaatgttctattaggtaaaaatagaaagtcatatcctaatctatattttctaattcctttaatagcttttttattttcaactatagtttcagctttattcttttcttttgtttttaaataatcttctaactcttttaagcatacttccatcatttttgagctatgctctaatacttcctttttcattttaacaaccccttaatttatatatttttctattgcttcttgaatagaatttgcatcagatgtattataattttcatctaaatattgtggatttacattatcgttataaacgattaaatcaaaaaactcgtttctattttcattaaaaaatgtatagatatttgaaagtggtatctccaacaaacaccattctttaatattaaatttagagttattaatatattcaatacatttatcaaaatttatatattcaaacaaacctaatgtttctaattctttattatttttattttgaattttatcaaaattgtttatatattcttcaatgaagttttttaaatttatgttttttgtattttttaatagatcttttgctatatctaatttattagtcatagtatttaaattttgcatgtttaatcctcctatatttatttttaaaaagaaaaagaatagtattgaactattctttttcttcaaattttaaatatttaagtattattttaagttcattaaaagtaaattcctctgaattatagctcatgtcattttcattttttagaaaatcttctaactctaatacaagttttacatcacagtaattagttatacttttattatgttctatatattttttataaaaatcaaccacatatttaaatgtacttttattagtttctctttcaaatctaatttgaataatatcatcagaaacaaaatctatatatgcgtcatcttctagtttatcctcaattaaatctgcaaaataatcaaaagcttcgtcttcatctttaattacctttaaacaattttgaaattcaattaatacctcatcaacattaatatttttatatttcacacttcctcactccttatttaaattttcactaaatttccttgttcattaaatttaaaaatatcatcaaaaacaattccagcattaatcatactttcaacacttaaacctaattttatatactctgttttttgatacttatttaattcgggtattagatattcacaatataaatactttcctacaaatttttttctttttattacttctgtcgataaagtatatgactcatatatttgtttatcaatagggtgtccttcctcatcaatattttctgcaatataccattgaaattttgtagttacatgtggtagtgcatgaaatattaatatatcattattatctttagttttaataccaaacttcctcattaaaaatcctcctaaaaaaagtagaaagagtattaatatactctttctatttaaataatatttttccattttaaaaagttatataaaaactgtactatataaataaaaattaaaaatagtatagccgatatatctttaaaagacagctctaaattattaaatgaataaaacacaataaataatactattggtgttgtccaaagaagtcttattagtcttcttctataacttaaattccaataaaaaaattcaaatcctttatcagttttttctccatcataaatattcaaaataccactcctaatttagaaattaaacttgtaatttaattataaattttacatgttcatttgtcttgaatattctatttcattttgcagtttttcatattcattcatatttttaatgctttcaaaatcatcttttaaactatctttaatcatcttaatatttctttgagctatgattaagtttcttttattttcaaaaatttcttttctattttggtacattttttgtttttttagttcttcttctttaacatgatctttgatttcttttaggatagaatttcccattctagtatataaatcttgaagtttattatctttatatgttgcagtttttactttcttttctccgtaagcatctttataaaattcatcttctttgtttaatctattaactaaatctttaaactcttctctcttataattgttgatataatacttacttagattatcaattaatggtcttgctctttgcatagtattataattatattgccattgtcgtttatctcttggaagaactttaatgatttctttgaccatttttttcatttctaaatctgctttaaagctcatatttttctttccatcaattaaattatctctaataattgaattaatttttgataaatcttcttgcttatttagaagtgaattaacaaaagcacttttagtatcatataaagttttaggtttaaattttcctctcactctagtaggatttacttcaactgctgctatatgaacatgaatatgaccagtattataatgcaaacttgccgtccaagttaaatctttaaaaccttcttttttttctaattctttcatggcatttcgagttgcattttgaagttttgcttcatcaacataaccagttttagaatcatatattccatgtttctctagccattcattctcaaaactaaatacagattgccacatattacttccattaatttgtgctacattgaaagcatttttaagctttttcttctcagtatcatttaaatactcattgtctttagtaaataaagctccaagcttttcagggttacctagataatcattgaatgcagaaaacttcttataattcttttttctagtagcttcatttctatctatatagtcaataaaatttccaaattctttttggttatttcttacgaatctaatactatttattacaccagccattgttattcatatgtcctataatgtttttttattgcttgtttttcaattctatcattaacagttttttgagccgtttgatatgcttcgtgcattctttcttctgtactcattatgtccatttggttttcattaataaataatccattaattaattcaataagaatttgaatgtttctatcattcttattaactccttttgctatcttatacatagctccaacagttttttcagaaatgatttctgccatcatattaacctgatcttctatagaaaaatttaaatttttctcatgctcccttattattaaatctaaagcctcactattacttctacaattattttttcttttaaatctctctatatattctaaagaattttctgtcataacatattgtttcttttctcttttcatttaaaattcctccttaacaatcgaatctatatctattaaaaactcttcacatatagcccttaatacaattgtatttatattgataactttcagaatcttatctactgttaatttataatctgcctcaaactttttcatttcatttaatactgctaatttctctatattatcttttaaaaattcatttctacttatacctttttcttctgcaatagcatctaatttagctattacttctttctttaaaccacgtatctttatttcacttgtactcatatataagaccttctttctttaaaaaaatgaaattatgggaacttattttaagctcccataatgaataaataaattaacttttttaaaaaagtttgcaaaaacactttatatggttgcgtactttatggtgaattggcaactacttgttagtgtttactttaagtgcataaggggaaattgcccccaaatactttgtggggctaggcaaagcctagcatttccgaggggacatagaaacttccaaatcatgaacttagcatgacaatagcactaccaaatcaacaccttttcatgacgttgtcatgatatattcaacaccaaatcatgactaaatcatgccaatagcatgattttaaaaatgaattatttaactagttctaataaatcagccttctttttattaagcttttctatcttttgattaagctcatttttagtattatttaagtttccaatctctttatttttgttctctatttcagttttaaatgagtttatttttgaatcagtttctgcaatttcagtttcagtttgatattctttttctatttctaaagtgctaatttgagaatttaaactttctatttctttgtttttatttgctatttcattctctttatttttaatttcttctttaattttttctatgtcattttcaactaattctacggttaaaccgtctttatttttctcttttaatgtattgtttattgttatatctcttgaatctgaatagaacttaattttattttttgagctatcaacttcatcactattttcaataaaagtcagtgaaactgctgaccagtttttcggtaaatttgaataaacaatataatcttcattagatacttttactaattttgtttctattaattctttaggattactcttttctctaagctcaacactaagagttttatcctcagttggaatgaaattttttatcttaacattgaattgtattaagttattttcagggttaaattctctgctagtaacttctaattctatgttatttaaacttaaaactttgtttaaaggtgtgctaattaattgcacttctttatttaaaagtagattagatgataaaaaaaagactatccctattgctataaatccacatactatatagttacctattgaaccatgtttctccattttatatttaatttcttcaagtttttcttgtaacttttctttaaccattcttcaatgctcctttcaaaaataataaaaaaacaaagcattattttataaataatgctttgttaattcttctaaatttatattcatttatattgtaaagtaccaaagttttttatattgatttaaaaacttttttaaggtttttaatttgaatttttttagtttatatttatctaaaaatttcaattcattatctgaattaggaattatattagatataaataactcttcattttcatagtataatgctacataaatagagttagtacgtaacattaatttacttacaattaatatttcttttccatgtgcatttactatcttagaaatataattttttctatttaaatattcctgtacggctattaatttatcattagttggattatttatatttttaaaattaggcaatgtatatactctattaatccaattaaaaatatctattaatctttctaaatttgataaatctaagctaataatatctccagttaacattgttttttcatcaattttaaatttaaaatattcacttatttcaaatggaataatcttatttttatctaaagaatatctaaaatcgcataaggaatattctttcataaaattatctttttctataatttttaagcctataaactattatatccataatatctaactaaataatattttgtattatctatagtaatttttttagaatctaaaatagtaccacgtaaaaatcttctaccattttgactttttttaagttcttctaataaagaaattcctaccataaaaaccacctacttttattcaattatccttctaacatttccattaaatgttctagtccaataaggctcatttagactatttatccaaacaccatgagttgttccatcatgtagaaactcattatttcctaagtagtagggtaagaacccagcgcctttctaaattactttagtaggtttccaagaactcccccccgaaccgtacgtacacctctcgatgtatacggctctccacttaaatttagtctaattttccattgtgaagtttccaatgacattcatgacataatgccaatgtttttctttttctaccaatcatctctttttcccactcttttttcccttttaggtcttttaatttccttacatggtgtatttctatatctttattttcactttcacaccattcgcattttctagcttttaatctatctataagacttgtttctcctctattcttctgttcatttggaagattatctaaatcttttgtaacattaactttaggatttatcttaaatccatcattataaaacttccttgatttagagcctttcttagtttcatattctatttggaatacaccatttttgcaaaatctatttgttattttgttaattgtagatttatatttattagcataagttttatacatactatatttcatatgataataaaatttattaagtacactgacattattagcaagtctgtagtagttatataatcctctgatttgtgaattataaatatttaaaatttctaaatcatccatattaattaaatttgctctatggttttgtttccaagttccatctttagttattcttagtatttttaggtcttttaattttttaacccatacatcattcggaacataaagcttacaagtatatgaatgtgttctttttacaattccatcatcacattttttaatatcctgacttcttgaaactcttatatcgtatcctaaaaaccttgccggtttctccgtgttcgttattaaagttttttcatcagatagatttaatttaagttcttcagctaagaaatttcttaaatcatttttaatatttacagcatcctgcttactacctattactcctatcagaaaatcatcagcataccttgtatagaacattcttttatatgtttcatcatttacaattattgatggaatttcatttcgtttttttcttaattctgaaatttcaactttaagtctatttatatcatcattagatgcacttgctaatttttttcttcttctatttattttatttgtaatatttatatagtcattatttaactttctttttattcctttattaaacttttctgtgtacttttcaataaatttatctagtttatctaaataaatattagctagtaatggacttagtattccgccttgcggagttccgctataggttttatgatatacccactgctctaaataacccgctctaagaaacttccatataagtcttataaatttttcatcttttattttttcttttagaatttcaatcaacttatggtggtcaatgttatcaaaaaaactttctatatctccttcaacaaaccaccttgctccatcataatgacatttaatttgtttcagtgctgtatgacaacttctattttctctaaaaccatgagagttggttgaaaagctattttcatatatttcatttagtatcattcttattacttcttgaactaacttatcgtctattgatggtattcctaacggtcttttcttaccgtttttcttcggaatatatgtcctttttactggattaggaacatatttctcatcttttaatttttctattaacttttcaattcttttaatactcattccatctatggttttactatctataccttctgtcatgtttccttcctttgcatatatatttccatatgcttttagaaagaaattcacattgtatagatttctataaagtctgtcatatttataattggcatcttcacttttattttttagactttttaatacatattctggatttctcataagcctctcgctccttccttctatcgtattaaatatttaagctaccttccttcgccatgtaataggctttccctatctccgactactacgaaggttccgttaccatattgaatattcatatcccttgagaataatagccttaaataaggcatttcaacttaggtaatccccatttagtacgt

SEQ ID NO: 30 - DNA, 82150 bp, Clostridium perfringens
gcaatgtagaccatagaaagtatatatctatgttttatgatgctatcatttaaagtaaaaagataattttatagttataaggctgcttacgctgctatcggtgtaaatatgaagggaagaaagatgttttaggtatttggattggtgctgctgaatcttcaaagtactggttacttgttttaaatgaattaaaaaacagtggagttaaagatattcttatagcttgtatagatggattaaatggctttaaagaagctataaaagccgtatatctgaatactgaggtacaacgttgtattattcaccaaattagaaattctagtcgttatttatcatataaagatattaaagagtttaatgctgatttaaaactagtatatacggctgtaaacgaagatgctgcacttcaagctctaagttatcttgaggagaaatgtggggataaatatttacttgctataaaatcttggagaaacaattgggaggagctatctacattctttaaatatccaccggagatacgaagaataatatatacaactaatgctatggaaggctataatagacaattaagaaaagttactaaaacgaaaacagcttttcctactgatgaagctttacttaaaatactttatcttgtaacaatagatataacaaaaaaatgggttcaatctattaggggatggtctcaaatcttagcacaactttcaatttatttcgacgaacgtcttgacgaccatttatattaaaaaatttaatataatagctttagtttttgtacaatttatattcaatataattacataaaaagaaaattaaggtttaaataaaatattatctaaaccttaataaattttaatatatttttttagatagtttacacaaaattattgacattctcttaaagtttactactcttttttattttgaagtatataaaatttaatttaatatttgtgaagttaaaacattattttttatattatatattttattgcatatattaagtatagaatttctatgagttactataaagcatgtaggtttataatctaaatttttaatagaatttattatatgttgttcagtatcaatatctaaagacgcagttacttcatccaataaaattataggctttttttgaagaattgctcttgctaatgcaattctttgtttttgtccttttgataagtattttatattagtgtgtattccatttggtaatttatctagaaaagaatctattttagttaaatataaaactttagttaattctgagtcacttacttgactattatgacataaaagattttcctttatacttttagtaaaaagcatatcatcttgtgatacatatgaaattaaacttctatgaatattagtaagtttattattatcaattaaaatttcaccagatttaggggttaaaagtgatgccattagttttaaaaatgtagttttacctgaacctgattctccaattataccaaaaaaatctcctttttttatactaaatgataaatcacttaatattttattatcgtcatattcaaaagatatatttttaaattgaattttttctttaaaatcactaatttgtttattttttaagtcttctggttctagtatttcaatttcatatattctatctatagcagccaaaacattattaaaactaggtatgtatgattgaagttctaaaactgatgaatttagttgtctatatatttgtaataaaactgtaaactcagcaatgcttaaatttcctataaataattgatatactcctattacaaaaattatagtgtaagataaaatagaacctaaactaaataaaaatgaaattccgcctactacaattgacatttttttatttaaatacattcttctactgtaaattttattaagtgaatcaatatttatttcttctaattctgatacttttatatattctatattttttaatgattcatccatagtaaccctatgatcaacatcatttttctgtatttctttagaaagttctatttgtttagtatttaatattcttgataaaatagtagttaaaattgaagatataagaagtattattaaaaacatataatttatattaattaatgcaactattgataatactattgtaagtattaatcctattgttgttggaattatttcatatatgaatgaaataaaagttccacaatcagtatttattctatttacaatatctaaagatgaatatttatttatcttttcaaacttgctatttattacttttttatatagattactttgtatatcatcaaaaattttgaacttaagtatagttgatatatatgaattaataggtgataaaattaacattataattgttaaactaataaaaattattattgaaatatttaaattagtaaaatctttatctaaagcataattaattatattttttgttattaaaattgataataatcctaaaattgatattaaaatattatataaagttttataaagtagtttatatttaaactttttaatattaaaaaatatatactctttcatatgtcctcccaaataaaaaaagaaaccctctatatagagagagtttcttgctaaattaagtaattagtctatttaagaccttctttacaccaacaataatatgcacctataaaatggcaatatctttcatcagaattcataacaggttcacaactacatcctggagtaccacatacatattttttagaatctttttcttgctgctcagttaaaattattggtttttcgtacataataaactctccttttatctattaattttatttaatatattaaattaatttaatataataattagcaaaatctaattttctcttataacacgaaccatctatagtgaatatattattattatttaaatatgctttagctggacatccagcattacatttatctccataaacacaatctgtacacttttttataaaagattttctaagagatattaaatctataatttttttatttttatctccatatataatatcttctaatgtgttgtgataaatattcccaatagagaattgcttatctaaaaaatattgacatggaaaaacatctccattagctgatattcttaacccaaattctatattcatcaaatctttatctaattcacatttaaattcttctatatctctttcatatacaatattaacttttgtattaagtttatcaattattgattttacttttttatagtcagattctaataatatttcattaaaactaccattttttttagcttcaactaaatcgagtctaagtacttcaaacttttcacaaatctcaactatacctttaatatttttatatgataaatttttactccataaattagttctaatatttaaaaatcctttaaaattattttttcttaataattctaaagcgtttatttgactttcaaatgaattttttccacgtgttaaattatttatctcagcattatatccatcaatagtaaattggatattaatattatatttacttagcattttagcttttttattatcaattaagcttccattactaaccatagcaactttcaaattatatttttgcataatataaatatttcttctatattttcatataaaaaagttctccaccagatagtattattccttctaaaatttttggatcacattgttttattatttcttctatgttctttacatcgataatttcatactttgaaatattttctttgttataacagtataaacattgtttattacataatgatattatttctaaatataaatttctaactttagcatattttaaattattctttgttactaaattactaggttttattaatcctttatttataaaatcttcaaaggttaattttatatcttcttcaatttctaaaatacttatattaatattgtttgataagttttcaaataatagtctagataattcacttgtacttttatctaaattttttagtatataagctgctgttttgtttaataagtgaattttatttgtattaaaatttcttaaaattatctttccattacataattcttctaaaattaaattctcattaataatatattctgtcacgtaagattgttcccaccttttaataaatttaaatattactattatttatagcaaatttattatataataaacacttaatgtaaactacatactttttttaaaataattgtaaaaattgtatggtttatatacaatttttgaaaaaataattggaatttataaagagaatttggatttgttaatgtaggaaataatgaagtcaaattaagacctatatataatggaaatcctgttcattactcttaatttctagataatgtttatttgagtaagcctattggaatacgaataataaataatattggtaatgtatatggttcagctgattttattgcattaaatagaattaaagatatatcaatatttttagaagcgtataatttaaaatatggagttgatagcattcaaataattctattttatgacaataacccatttactataactggtaatgtgaaagcaaatttagattattatgattacgaaactaaaatttctaagaaacaagcaaaggattttaaatttagagttaaatcagatggattatatgctgagtatatacatcaaacagttattcctgatgatgaatatataatagaaacaagcaataatttaaataatgttttaagtcatgaaaatgatactgatcttgtatcatttagttttaatgattcattaaatcagaagtttttactaaaatatgataaaaagaataaagcttataaaatagtatctcaaaaaaaagggtttttattaacttgtagtgagtatggaagtaaaaacatttatatgatttatgataataattttagtggtcagattgggtattttcaaaaattactaaataaaaattataggattgtaagttcgcttaatccaactaatagaatagcatttaatctagataataattatataaaaactgaatacatgaatgatgatataactcaataatttagagtcgtaaaaacaaatgaaaagctaaattttttatctggagaatttaaaatatcatctaaattagacgagaataaaatattaactgctgatacatggaattataatgtaaatatatttttaaataaaaatgaaaaaaatcaagaatggttatttaaatatcatccttctaaagatgcctatacaattgcaagtgtttatgatccaagaatagttttagctttaaatgttttgggagacccagaaaatgtagttgtaagttcatttgctggaaatataatagaacaattttggaaattggaacaaaatccagatggttattttattataaaaagtgttaaaaatgaaaatttagttattgatatccaaagaaatgatcctagtaatgagaacaatataaaggtatatcaaagaaagtattctaataattcaaatcaaaaatttaaattttcaaaataaaaattgagaatgtcaataattttgtgtaaactatctaaaaaaatatattaaaatttattgaggtttagatagcattttatttaaaccttaattttctttttatgtaattatattgaatataaattgtacaaaaactaaagctattatattaaattttttaatataaatggttgtcaagacgttcgtcgaaataaattgaaagttgtgctaagatttgaggccatcccctaatagattgaacccatttttttgttatatctattgttacaagataaagtattttaagtaaagcttcatcagtaggaaaagctgttttagttttagtaacttttcttaattgtctattatagccttccatagcattagttgtatatattattcttcgtatctccggtggatatttaaagaatgtagatagctcctcccaattgtttctccaagattttatagcaagtaaatatttatctccccatttctcctcaagagaacttagagcttgaagtgcagcatcttcgtttacagccgtatatactagttttaaatcagcattaaactctttaatatctttatatgataaataacgactagaatttctaatttggtgaataatacaacgttgtacctcagtattcggatatacggcttttatagcttctttaaagccatttaatccatctatacaagctataagaatatctttaactccactgttttttaattcatttaaaacaagtaaccagtactttgaagattcagtagcaccaatccaaatacctaaaacatctttttaccttcaatatttacaccgatagcagcgtaagcagccttattaactatagaattatcttttttaactttaaaatgaatagcatccataaaaacgataggatatatactttctaatggtttacattgccattcttttatagaaggtattattttatcagttatatttgagattaaagtaggtgaaacatccatgccgtacatttcattaacttgagtagctatatctcgtgtagacatgcctttcgcatacctcccccctattattgaactttctagtagtttgatgtttcttttcgatttgtggttcgaaagaaccctcacgatctcttgggatatctaaatcaaatttaacagttttctcattttcccaattacgagaatcagtagtatttttatttgaataatcatattttaaatatcctaaatattcttccatttcagcttcaagtatttgttgaattaaaccaccaaataaacttttaataacattttgagcatattcagcagtctctatattagttgttttatcaattctttttcggcataagatatagtctgtgcaccctccttttatatgatatttaattatatcatcttattagtttacacagactattttacactctcaaattagacttaagattacaaagttttaattttgaaagtctaatttatctttaagaggaaaattagattacatacaaatctatatagagtttttattagaattaatattaatctataaaactaaaatcttatttttacttctaataaataatcttattttattcctggtgccttaatagaaagactcctatattttactatatttgaatcattacttttttcttttttatctacaggtattacatattcttgtacattatttgtatttaaatttctaaccttaactattaactcatctcccataactgcactataatttccttttccattaatattaatagtaccatcttcatttaaatcactcttatttactgtatccgataaactaaatttataaccatccctaggaaaagctaaataactaggtatctctccccattcacttccacttacttgtcctactaactttacatttcctttaacattaactttttttaaatatgctattacttctacagtagtattagctggtactagtatatcttgtgaagggacattatgagtaatttcttttgaattagtatttgtatttgtatttgcaaaactataactagtagttaatgatactcctgtttcattaaaaggaacagtaaacttagcagttgcttgtatcgaagttcccacagtatgagtagtagttgcagttactgtatcagtatttttacaagtgaatgattgtgattttaatttttgttcttgttgagtatcattagttaagagagcttttccaacataaacatcttcaagataattcattgatggttctccatctaattcaactttaggattattaatataaaaatcatttccttgtggatttatagtaaccttatcaaaatatgccatagcattaggataatatttttccattctctttaagtaattatattttgtattatatcttcctttctcaattaatgtatctacattatcataagaagcttttttggacatttcattagatactgtattagatatttccttagctattacattagttggtgaaacaatattaactattgaatagatggatatcaccgctgatgcgattgctaaactttttacaagattttttttcataaaaccaccctttcattaatataattttctatattttactatattttttaaaaaaagtaaataataaaaataaaattatttaatataggcctagcacccatggccgtcaacctaagaaggcataaaatatcaattaaaatttagagtggaatttttactacaattgcattaaattgcaagattaaattatataaaatcataaaacttgtattttaaaacaagataaaaaagcctataaatttttagtagtaaatttataggttattgaatcaatattattgttaaattgcaaatcttgttacttcaaaagattctaatttaatgagttttaatatattaaaagctgtttttttataatttttcttagattttattccaaatcgtttaaaattactcaatacgctttttaaaattctactaatgtaaaattctcctttgaaaatctcaaaggagagcttaggaaagtattgaattaaattcccgaaagctttaagttcactaatttctttctcatctacttctaaaataatagatttagaagtaaaaacaatggtagatgatagtagtaaagctattaatcttccatataaaaagcacataaatcgctctaatttaacttttttcacttgattaattttaaatatagatttccacactttaaatattatttctatttgccatcttaaagaatataactcatgtacttgattcatagtaataatattactagatacattggtaatataggcatttatgctattaaaatctaatctcctttgattcaatgttaatcttttcttttttataccttcaatatgattaaatattcttttagatttgttttcttcagttaattttgttataattaatctgcttttaagctcttttttagagccaatatagatatcagtaagttcaattgtttcgcctgctgctaaaggctctgctaacttaatgatatctatttttatatactcactagacttttttatagttccaaccttatatttttcaggacttggattttttatatataatgaagtattactttttactttcgatataaaagctgtcccacttttatcaagtctttttaaataatcaattttaaaatatcctaaatcagctaattttaagtctttgtaatctttatattttttcattgttttcaaatactcaacatcattttttatgcctgaaaatatatctatattcataaatgaaccagttaataattcatattgtaattgtacttttattgatgatggagaagcgactcctccggaacccggaaacttctttttaaactctttaggtaaagtaaaacttatagaatcatttataatgactctatcaaaatatgttcttaaagtacgttctaagttagttaatgtattattttgagaatataaaaatttaataaatatttctttcataaattcaactgagtatttattaaaacgtttatctaaagcttgtttaggtaactgcttggaaaatatcatatcatattttgcagctagttgagataatggagccgtacagatatcggagccataaaatacattaaacatcaaaaaatctttagctgttatactgccttttctttgaataaattttgaatcttttgctattttatttatttcattaatatcgaaactttcttttatacttttagataaatatttaagttttttgttcataaaattaggcctcactttctataataattaattaaatattatacattattatagaaaataaggcttcttaggttgacggccatgggcttccaccctattacactaaaaactatctatgcagattataatgcacattatggtaataagggaggggctatttatagacatgtaagtgatcagtatgttcctttttatgtgcaaatacttcaaggaagagatagtaatcatgtcttagatggacttttatatcatggaactaatttaaatatctatgaacattcaacagatacagctggatatacagagcaaatgtttgctttaacatatttattaggatttaaatttaagcctagaataaaaaatgctgagcagcaacaactttattattgggaaagtattgaggttggaaatgttaaatttaagaaaataaaccaaagtttaataattgataattacaaagaaattttgagattaatagactctataaaatctgagaaagtaaggtcttctcttattttgcaaaaacttggttcatactctagagataattcagtttctaaagcactaaaagaacttggaagaattttaaagacaatgtatcttttagagtatttttcagataaagaattacgaaaagaagttcagcaaatgttaaataaaggagaatcaataaactcagtagcacgaattattcattttggtaaaaatggaagaataaatgaaactacaattgaagaacagttagaaaaagcaagctcattaaatattttattaagtgtgcttattgtgtggaattctagatatttagaaaaagtatataaaaatgttaaagataaagattggtttgatgaggaactttttaagaaagttagtccattaggaactactcatgttaattttttaggagaatatacttttaaagaagaaaaaatagtaagtgaggatggtttacgcccattaaaaatagaagactagataataaaatatctagtcttctatttttaatgatacgttttcggtgaaaaaacggtgctaggcctataagggggattagggatggagaattttataatgtttgctattggaatatatatgtttaatatagatcattgggtatttaggtttgttagaactgggttatatggattaattacaatagatttgataagaaatttaaaagcttttaatttagaaaatgtactgttaatttttactggagttattatgttaaactcacctaaaataataaaattctattttagaagaaagttttattacagataatatgcgtttttactttaataaactcgtgtaaagtaaagcataattatcatttgcattatttaataatttacttagtttattgcaagtttctttataaaatccattagatttggcatattcaattgttttatcaaaacttagttcaaatatgttatctacaatattatagtaaaaatcactatttattactccaaagaagtattttatactttctttaaatgataatttagtgacttgctctaaagcacatctttcatctgtataataaccatttttatcattccattgcagaaagtttaatatcttttttctatataaattaatcaaagatcatcacctcatttataactaaaaataaaaaagaagtatcttaaatttttaagatacttcttttagctatgaattaaaacaaaaaaacaactagtttattaaacagaaactttaactattaaaaaagcaacttaatagtataactttttttataatttatagatagtattagatttattttttaacactaaattcaaaatatcaaaaaagtgcctattataaataaggcactttttgcattaaaattaaaaaaataagttttgtccataaataaagtaaaaggtactataattatacaatttgtatttatattatgaaaatacttaaaatattcatttaacaaattgtttaaaatatagaaattttaaataaagctgctctatttttgtgttttttaatcttattaatatgtaatttgtaactatagaagtactagtcactataattaattataacattttatggagtaattattttaaaatttttatttattattattacctagtaaacttagtataattaaatcatataaaaaatcatcacttgtaaagttactcaaatcagttttcttaaatacatttagaatagcttttttatcatttttacgtggaaaggctatatctaaaaactccatcattttctttttagtttgagttcctcctagtcttgaagtattctttagaatattttctctctttttgaaaatttcatcttcagtatctctaaatcttgctttttctgcagcatttattatacctgcagccatttttatattagcctggatttgcttctcgtttaatgaaccgttaaaatgtctaaattcaactgtaggggctctatctcttgctatattagttaagttaataccataatacctatttccttcagaaatttctgctgccattctttttacatcctcattattatccatgttgaatcggatatatttactttcatcggccctaggactaaatggagtggcataatgtctggcattacttcttactcttcctaaatctccacctgcagctctgtaaatacaatcctcatatacttctatagtcttaaaaaatcttctccatctttgtcttgcagtatctagtttttccatgtttatatgaacatgaccaccacacctttggtcaactctagctccatgtcttttagcaacatcacatattacttttatttgttcccaagtctctggagtatctttaagaataggagaaactatttctccaccggcatctccatcggatacggaaccatctctctcaagcttccatttgcctggctcagttcttgagtgatagcctaatcttctaggagaactaactatacctagctcataaagttctcttgctatagcattagcatcaccaccaacaaactcaagttcaactccgaatgtactattgtttccgtttagtacgttttcgtactcatattctatagaatcgtcattaatttctgcaaaatcgttatagaaatcaacttcattgtctgtataaaagtgattatcgtcttgttcttctccacgaatatttctgtttatttcatctcttatatccctagctcttctagtagcttctacattgtttatagtatctacttctgcaacttcgcctaaagcttctctgaccgctattaagtgtctgcagcattcatttctataaacatattggccacattcacagctattttcattcatatcaacaatgtaagttcctccttcagttgaacttacttcatatcgattattacctaaggaaactatatttatatcttcaattctgtttctggtcctagacaatccttggacagttacaatattatctaatctaccattaacagcattaactaaatcttctattattccttcagaaagattagatcctgagccaccaattaatccttccgttgtatttgcaatagtattgattcttcttttcggcataaaaatcacctctttcataaaataaaaagaagtacagctattgctatacttcttatatgtgcaagaactgcactaattgaaaaagtttcataaattaaagctatttattatacttctcatataatttattgtactcactagtataaaattctagattatttttgaaaatatcatctttagaaatagatttatctagttgttttttatcttttacagatactccatttctactattaacccaagcagcttgatgcataaaagatatttttctacttttacttattttaaggatttcctcaattctttggactgaagaaatacctgcaaccactatttctacatctaaaggtattttaaaatttaaaattttaaatcctagcaagtagtgtttccatgagttacttgctttaagtttagtatctacattcatgaaactaaaagctatagtttttatattattggccttgatttctcttatccaaaagtttaaatcttcttttgagtaccaagatatatccggaatagccggaaggccctcacgtatcatttcattataagcagttttagaacgttgaatattatatatatgttccaggcgtggagcatcttcataaactgaaaaattaggagctattattcctaaaaagtcctggtgttttaattccttataaatagattttcgattatcccaaaagccttctaaggttctatcctttatataaaattctaatattccggataaatattcttttaaatttaatgcagctctgaatccatgattatatgctcccgttattttgcttccagcagcatttaaaaagaattctccatgaacagcaattatatttttattggccttaaaattgaaattttctttgattttatcaggcattacaggaatataaatgggtaaatctaaagatttattccccattaatggttcctttactatagtattttttactaaagtaaaagaaccgaatttattaggacaaataaccatacaacgctttcttttttcaccacatttacaaaaagaaacatcacacatggaacatccattacacatcttttcttttttcataacacagctattacaatctctgccacataaactaatcataaattaatttctgaacctaacttacttaaagatttagatgtgtttaatataattttattcaacatttctttatctgaagaagataaactattcttatcttctattaacaatttagcttgtctatttataatacgagtttcttttagaaattctaataatatttcacccatattctcacctcaatttttaatataatattcctttcaggctttcaattacactttctgctacctggattacgatactattaccagccatcttatacatttgcgtatcagtacagtctttcccgttataaaattgttcttcaagagcttttctaactagccagtaatcttcagatgtgaatcctataagtctccagcactctaaaggagtaagttttctaaccttacattgaataatcttaggaatactatcagatccagttacaagggttgggctagctcctagctctgagaaaacccttctattcatttgtaacatatgtggatttttaattgttccaactctaactaggccaaacttgctaggctctttatccttacaaattcttttattaaccttatttaaaaagctttttaaataagaattatctttacaatagtatttttcatctacaaaactttctgtaatgctctctagtataactagattatcgtttccttctttaaacttaaagctcccgttgtctatatctttcctgatgctgactatgaatactctttctctagaatgggccgaattatagttaattccacttagtattttccagtaggagttatatcctaatctatctaattcattaattaaattatgaaaatcagaaataaacattttacttactaaatttctaacattttcggctatggcaaccttaggtctagcttcttctataatccttagtgcttcaaatagcagcccggattttgtttcacctttaattattcctttacagcttcccgctaagcttatatcagtgcatgggaagccataagttacaagatctatatctttaaaatgtgttccatcaacccaattaacatcccataaattcttagcttcagataacctaaaaagtttactataggcataacttgcatacctatccttttcacaataattaactatctcatgttcaatatttttattctcaatagctctttcaaaagctcctattccactaaataaacttaataccttcataaactcttcctcctttataattcttctgaaaagtatttacaattaacctttctaaaataagtccctcgcttattaaggcgtagataataataaaatcttttatcaaaaacaactttattcttcttaacttgaattacctttggattacgtacgtaatatacacaatccttacaaggctttctactttcctttctctttggaataaagttagtacattttgttgctacttcaggatcttctatctttatcttaaaatacatacaattgaattctttatatttatcaaaattcttacataagatacactttctcttattcatcttacttcaccatcactttacttcttataaaatctattaatatctaaataaattcaaatttacatttaatttatatattgactttttaagtttttaatgattagatcccgagtaccctcaaaatgtacatagttatcctgtccgatttaattaaaaaaagaacaggataactatgtcaccgaattaagatccctatgcagagcctcgccacattaacctatggtcccggtaacaacacattagtgattagtatttcacctaatccgtacatcaaaacaggaattgtacccctacctgtccagtatttctactgctctgtacgttcctttcgttgcagcttatttttaagctgcaggtactccacgtaaccgctgaattttgtcatatagcttttatagagctacttagactaaacatcttcatcagagtttcaataagacttacgttataccctcatatatgtgtaatatgagaatagccggatcaactttcttccttggctcaatcaaacccttgttagctttcgctaagattagtttatagtgtatctgctcactccggtaaatatttacgttatcacaacggctttaccatgctcctatttaagttataggcaactgtatagatttgtagtctatactctaaaaaagcatataaaaaagcccaaactcaaattccttgagcttggactttagaactcgcttaaattacacaacaaataaacatagtaaaaatcaaaatttttaaactatgaaaaatttatatatgtaatttaaacgagtatataacttattattaatttcttatagtatttttatctttttccttgagtaaattaattatacaatatttcctaaaattagacaatatattaccaaaattttttataaaaataacgatgataaaattatattatcatcgttattttataatctacaattaaaaagttaattttctgcactccataaaactttataattattattaggatatctattttttaatatttcttctaatggctgggaatagtccacattaaaatcattttttattataggctctattgaaattcttgaaatatctaatttattattagatttaaaacttaacatataaatcatattaaaatatttaaacttacctgaactatttttataagaataaataaattctatactaatataatctgaatctttttttctattaaattctaaaagtttttttaattttaaatctgaataattattatcttttgcataaatatcagaatcttttgttacttctgaatatacttcattccattgctctttagaaatttgatttatatctgttaatttatctggtagaccttctatagttacttcagttggttcaaatttaaattctacattaaagtctcttttatacaactctttattatattctaagtgtagtttaactttatctccattctttaaatctgttttgtctcctactaaagttattttatagtctccttttagcatatcaggagtaagtccctttaacttaggaatgtcttgtagctttcctaaatctaaactactttcatagattttagctgaaccgttaaattctccatatcgtacatctatgcagttacttatatctagcttttcagctccgcaacctacgaaagcaaataaacttaaacatattagacctaaaaatactaatttcttcttcatattacctcctatattgaaaataagtttattaaatgaaatttttgtatttctagcattaatattacaatgcttattcctagtataacatattcttttaggccaccggttctatatcttagaatacctaatggcattttaatatctttattataaaaaggtaaaaaccactttatgccgctttctgagaaggtatcccctactaaatggagtaaataacctaaagcgatagattttataaatagtgattttaaaaatatgcctaaaataaatattaatattacaggagttattgaatgaagaaatcccctatgcttaaatattgtacttaagggataggagattatctttaatctttctcgaataaaactatttggagtatctagatctggaagtaggctccccaagcctactcccgttaatattaaaattgatagctcgttgcttagatataaagctggtattgcaacatttagtgatgttgttaaatgtgttttatatagcataatcagctctccttcttcttaaagtttttgctatttcctttcttaatgtattctaatttattttctaaatgcttttctttagattttatatcattattgcttactcccataaatgattttactctctcaaccctttccttagttgatacttctttaatttgttttttatctggagatttttcttttggttttccattatttttgatattttcaacttttttagtagattttttcttaatttctgtaacttctggtgatgaagctacttctatattttcttttgtttctggattgatttcagtatttttagaacttatattattattcattttttctttgtttactttaacatcatttttggctttatttatagcttcaacagatttttcttccactaaatcttcaggaacttcagtaacacttatattgctatcattatttttcttatctgtagatgtattttcattttttagttcatttagattttctttatttatagtcttttcaggagtttttatttcttctggttttgtagttatttcctcatcttcagaaatagttttattttctttacttcttggacttttatcctggatagttccagtatcatttccgttatttttaatgttttcatctatagttttaggagctatatccttattttctataggatcttttatgtcatttttagtaactgcttcttcatcaatattaggtttattttcgtcattaatattcttgttaggaatattttcagaagttatattgctaggtttagtggccttaactccatttaaatcaaatttttctacaggttttttatttatattttcatttgagttaactttatttttggtatcattaactttatctatattttcttttggattattagaattctctatatcttcagtcttattattttttaaattatcgtatttagaacctaagaaatctatagcttgagctacttttctatctttgtaaagacttaaatttccctttgtatattctttaacatattgagctttagttattaaattatctcctatgtcataggctttatccatggctggatttactgcatattcctttgtaatatcagcacttttatctagtgttttagatccaaacttaaatgctcctgctgttcctggagcaattctattttgaagatttattaacccgttcattaattgttttctaaaggcaataaccatgatccaacaagtacattgcattaaaagagctattattaagttagctccccatgattgaaacattgtaagcgtaacagtatctacaagaaccagtaaggctaatacaaagctactaacaattataccaagctgagttcctaaatactttcttgctataccctttataatatttgtaccaccaaagaaaggcactatagcaataagcataataaatggtaatagcaatattaaaagaattgacataagctgaaatcctatttgtatcattcctacggctattaaaataatcatctttattaaagttattacgaataatacacatacagatactaacttagtatttatgccattcttcgaaaataactccttattgaatttttcatttattgattctaaagctttttctcttttatcactaccataaggctctgataatatatctttagaatattttattgcttcttcattgactctattatcattttgatttaaaagctctaatttcccatcaaattctagcattacccatggttgctgtacaaaatttccccataaggttcctacaacagttttagaataatcttctaaggaaccctcattgttgttatctttaccatttatagcaactatggcactagttcctatagtcttagaaaattccgttgttttagataagaagccaacagctccgttacttaaaaaagctgtagttgcatatattatggctactgcgagtatttgtgatcctatagcactaaagttctttttatatagattataaactattgaaaacaatgaaatcataaatactatcataaagaaattattgaaaatcccattatttagagaacctagtacactatttaattgatttgcaaagcctgcagctatatcatttgtgaagcaaaatctaaatatatttactccaaaccaactaatcattactattccgctaaatactatattagttagtccagttatagctttatctataagctcccaaccatgagtatctataatatctaaagcatagttatttctatatttatcagcaataaactgcccccaaccttcctgaatgcttttataaggatcatcactattaccatagcttaaaaatccatctgcataagctattttagttaaacagttgtaagctataacgatagttgcaattataactaaggcttttaatatatttttataagttaatttatttttcaaatacagaaatttactatatatattaatcttcacattctccatttcacacctccgattaatgttcgtaaatttataaaaaagtacctggatatttttaaaaatattgataattatccaggtacttttcttcttaaagccgaatttttattctacgactcttcttacatttccgttaaaatatctgctccaataagcactatttaggtctccaatacttactccttgggtagaactatcatttaggaatttaccatttccaaggtagtagggtaagaacccagcgcctttctaaattactttagtaggtttccaagaactcccccccgaaccgtacgtacacctctcgatgtatacggctctccacttaaatttagtctaattttccattgtgaagtttccaatgacattcatgacataatgccaatgtttttctttttctaccaatcatctctttttcccactcttttttcccttttaggtcttttaatttccttacatggtgtatttctatatctttattttcactttcacaccattcgcattttctagcttttaatctatctataagacttgtttctcctctattcttctgttcatttggaagattatctaaatcttttgtaacattaactttaggatttatcttaaatccatcattataaaacttccttgatttagagcctttcttagtttcatattctatttggaatacaccatttttgcaaaatctatttgttattttgttaattgtagatttatatttattagcataagttttatacatactatatttcatatgataataaaatttattaagtacactgacattattagcaagtctgtagtagttatataatcctctgatttgtgaattataaatatttaaaatttctaaatcatccatattaattaaatttgctctatggttttgtttccaagttccatctttagttattcttagtatttttaggtcttttaattttttaacccatacatcattcggaacataaagcttacaagtatatgaatgtgttctttttacaattccatcatcacattttttaatatcctgacttcttgaaactcttatatcgtatcctaaaaaccttgccggtttctccgtgttcgttattaaagttttttcatcagatagatttaatttaagttcttcagctaagaaatttcttaaatcatttttaatatttacagcatcctgcttactacctattactcctatcagaaaatcatcagcataccttgtatagaacattcttttatatgtttcatcatttacaattattgatggaatttcatttcgtttttttcttaattctgaaatttcaactttaagtctatttatatcatcattagatgcacttgctaatttttttcttcttctatttattttatttgtaatatttatatagtcattatttaactttctttttattcctttattaaacttttctgtgtacttttcaataaatttatctagtttatctaaataaatattagctagtaatggacttagtattccgccttgcggagttccgctataggttttatgatatacccactgctctaaataacccgctctaagaaacttccatataagtcttataaatttttcatcttttattttttcttttagaatttcaatcaacttatggtggtcaatgttatcaaaaaaactttctatatctccttcaacaaaccaccttgctccatcataatgacatttaatttgtttcagtgctgtatgacaacttctattttctctaaaaccatgagagttggttgaaaagctattttcatatatttcatttagtatcattcttattacttcttgaactaacttatcgtctattgatggtattcctaacggtcttttcttaccgtttttcttcggaatatatgtcctttttactggattaggaacatatttctcatcttttaatttttctattaacttttcaattcttttaatactcattccatctatggttttactatctataccttctgtcatgtttccttcctttgcatatatatttccatatgcttttagaaagaaattcacattgtatagatttctataaagtctgtcatatttataattggcatcttcacttttattttttagactttttaatacatattctggatttctcataagcctctcgctccttccttctatcgtattaaatatttaagctaccttccttcgccatgtaataggctttccctatctccgactactacgaaggttccgttaccatattgaatattcatatcccttgagaataatagccttaaataaggcatttcaacttaggtaatccccatttagtacgttgtaaatagcatattgtaatatcggatatgactttcgttctttatctttcactaagattacgtgatatctgagacactaaagaatatacggcatctatttatattcttcttgacatcatatgtcgttttatagctatcttccgacataagccacattatactcgttcgaactatcattcaagcagtctagcttttatccttatttacaatctttcatcttaccattcagtcgtatcttgataactagataactcatggtttttccaacatgctacactccccctttggtttccctctaggataagttggctgatgataggtttaattgtgtcttttacctaatattttgctaaaatataatttacaacacccttatgggcgcacaatgccgatatgcccgttccttccagcagtatcgaagaatattaagtctccacgcttcatttcacttgcaggtacaggcttacccatgtttattaaggaccatgttgttacactttctcttggccctaaagttattcctgcagatgcataacaataatgtactagagaactacaatcaaatcgtcctgcatcaacgtcagcttggttacgaccgcctccccaaacgtatggggatttgccaacccatttcattccagcttctattgctttttctataacatcattccctacaacatctccattcatatcgtaaagatttagcccaaaatcatttattacctggattaattggtttgcatagtttggatctgttgcataacccgctttttgtatacattgagcttgctctatataattagttgcgtccaggactccattttctttatatctagaattttctacaaagaatttaccatgatctattacagattcattccaactttcataaactctccatcttgctataatagttattattcccccattaacatgctcctgagttggcatttctaaaactttccccttccatccagagtcagcttttataccaaataaattattagcttttatggccaacccagaccttccccaaccactttctaatatagcttgtgccagggttattgatggaaatattcctgtttcttcataggattgcttcgctccggaaacaatctgacttataaaattaagctgctcttccgttaaattaggattaggatttactggagttggctgttcaccacttccccctataattaagaaaaaaaatagaagtggaaatatcaaagatattattccactccatataaaaagctttttcattaagaaacatcctcatagtttaaggtatcttctggtgttgtgctaaaacactctataaactgttcaaaaacagcatcaaattctattactccaacccttccatctaagtcttggaaaacagcttgcctattttctaattccataagcattttaatattttcttcagtaatgcttttattcataaattcaagcattctctttgcttcatctctattattagttttaaagcataatttgtatgttatagtatttttaatttcttcagttggtatatctaaaacagaatgcccgttaaatatacatccaacatttaaggatcttccctgtcttgctaaaaagtcatataattttctacctgcagcagaatttttcaataacgataggtaaatctttgatgttatctccaatttttcccccgctccacaccgtacgtgcgactttcaccgcatacggcgttccatcaattatatattgaattcatttttcttaatcttattcttgttagaaaaaacttagttgattataagcataatcacttttaattgaaatctggaaattgcttattaatttccttaattcgttaattttttttagttgtttatttgacaatgataatttgatgattttttctttaatcttgcataaatcagtcatgtgaattaattcatgaatatttttagttactaaaattagattcttatatgaatcatctttagttatagaccataatcgtttatgatgacaatgcatgtcatcaagaaacatttcaactcccgttattgcacatttacctttttgtgatatgaataatgatatacgattatcattatattctacactagctcgctcatttattactggatgttctcgtagccattgcaatttccattctggaacaacttcttgttccttatgtaaataaattctaccttccggtgtatatttatttttgcagtgttgcttaagttttggtttccatgttctaatatatcctaatggtaatatggggtaatcaaataaatatcttatctgttttgatttaatatactttttgattcctttatcattacctttgtaaactcctatcttagtcaagcctttgttcttaaagtaattataaaaacttagcattacttgataattgataggtttaaaatcattgtttacatgcgtcgctttattgtagtagttgtgaattcctattatcatactattgtatttttgaatttctacaattgcttttatcttattgtcggcgttacgaatccgttttatttgctctttaaggttattttttattttcttttttgctttttgagtaacatgagaataacaaacctttttcttgcctttttttaccagtctaagtgtgaatcctaaaaattcactattttctttttctaaatttgtaatttttgatttttcttcagaaatttgtagttttaatctttccgatagccacattttaattccataaaatattttcgtggcatctcgtttattcttacaaaatactttaaaatcatcgcaatatctaactatatacatttcttttaatttcgatttttttcgtaacttattaaagctattgcttttatcgagataaccttttttgttatatgaaggtttcatctctcgacaagttcgttcttcccactgtttggctatccaccaatcaaactcatttagtactacatttgccaataatgggctaagtattccaccttgtggagttcctttggttggtattgtaacatccccattactcatcacaataggtgcttttaacactcttcttataataaccaatagagctttatctcttattcctattgaccataactgcctcattaatttgacgtggtttacattatcaaagaatccttttatatcaatatctactacataagacatgtggctttgattcattctatacatacacattgcaatcgcattttcacatgaccttattggtctgaatccataactatgtttataaaatttcgcttcacaaattggttctaatacttgcaatatacattgttgcacaatcctatcccacatagaagggatacctaatggtcttgtttttccgtcatttttaggaatatccacacgcttgacctttctaggtttatatcgcttgaatcttttcctaacaatatttatgaatatatcttgtggtagattttctattttcttaacagttacaccgtctatacccggagtaatacttccgctattttgcttaattgtcctatatgcaaggttaatattatctgttgatgtgataatatccattaaatttttaaagcaatttcctgccttactttttgcatataattcatcaaatatttctgtcattccatagtattctgcataacgtaatttgttatcttttaataaaatttcttctctaacaattttattcatggtttatcactcctctcacaagattcgtgaccttttgagtcttactagaatccatggtagtgattaagtttctttcaataaataattgacttgtggctattcctccaatttcattacaaaatcttcatcagtcataccactactctcactaaagattatgaaaggttatgtattccctttcttcgcttcataggtgtgtatcctccacgtctttagctttcgacgttcccttaactttatcaatactagaacttaggtgctgactttaccccattggcttatcatatgcctataacatatcaaggattttcatgggttccatttttactcatcctcaaaccaattaacatacatttctatacttatcgctttggagcgtaccttcgccagttcgtcagttcctattggaacattctcaccatattctgtttttaacgactcccggcatatcaactacatattctacctctagaacactttcgttagataacattttattatctgctacggtaattttctgccgacttcaccgagcttcacacaataattttcacacaaagttactgcatgtcggagtattagagaaagcgtttcaaggcgttaccctatcattccacttttcaagttaagagttctccattctcttatatttagaatgtgcatagtcttttcaactatgaacgtctcgcacaaaaccaactttcatcaaagagtattaagtcgaaggtatttctttttttcatagcaaatttcttcgtaaaacttcccataagcatcattaaacaagaacttaatttttcttcttcagagtattcttctttctttgtaccttgatctggaattgttaaattatctatttgaagaatatttagtctattatctagattaatggctttttcagtcccatctccaaaaataagtttagataaacctacatcctttgatgcatttagttttcttaccaaacgctctgcttcttttttataggcatcactatctgatacatcgttaatcatttcgattagtcgtttcattgaaggtcttttttcatccttcattttatttagagtttcttttaaaattatcttttcttcttcatttgtgtttgcaatctcaactattatattaaaagctaggtcacaagcttcgtctatattatcattgtaaagattaaatggatctagtttacccttatcttcatcgttaggtgttaatctaactatacttattaaatcccccatgaaatctagtttagcagcccaatgtgacctttcacttttaggatcaaaaataagtgcggaactaccgaaaagcacgtgtaaaactacaattaagttagcattaaaagattttccaccacctaagttaccgtatatgcccatagcaggtgatttatttaactttgtagctcttcccatgtataaataaacctttctattaccatttactgtgtaacctatataggctcctacgctatctcctaaatggtcactagctccaaatactcctcccgctaatgtttccattggaactagctgtatgaagtctctattataattagaattagcaggtataaaatctaagaaaattctatactggtctgtatatggatttataagctcaaattttaaggatttattgaaatattccataagaactttggtattatttctaactattttctcctttgtggaagctaaacaaatacttatacttgtttcgattatatgtttatttctctttacttccttttctaacgactctgcggccgccttcgcttcgtattcttcatcagatggtatatgtcccccttgaagtgcttcatttacctgtgcatttatcttagcagctttattttttatcttacttttactttcttccgcagaaaacttctttatgtggatgcagatctctgcaccaatattcatatcctggattaactttatatactcaacgcctggaaactccatacttggaatattgtttatggccaagaaagtctgataacttgtaaatccatcattttgtatttttaatattttatccccttgctctataagaccagtaactctatttttataggcgtttcttaaaggaataataactttttcatcatcttgctctacttctaagcagttatcactccacttaacaagctcatccgctgattgatgaccacgtttagtaaccctggcacttaaactatctatttcactttttcttaaagggcgtatatcaaatctcatagattgtatttctaaaaattctgtagactttttcttataaattctaaaatctctttcagatatagttttctgagatatgcctaaaaactcatttaaagcctttttagggctttttatcatatactcgaacatttcccctcctttagaaataaaatccttgtcgtcgccttttagaagggaaataaatatatatgtgtcatattctaatgttttatctccagcaatgaattcattttcttcagtaacaggattaaatatatatctatcctcagctctttcttctaaaatttctatagttttctctgctaaaattgttgaaacttctttcaaaggatcatcttcctggattttatttatcataggtcttatggatctctcacaatccaccgctcttggaattaataaaacttgagcttcactaggtatttcttttataagttcggttaaactatctaatatcctaattttttcactattattacaagaactatattcaaatccattaagtttaaatcctgcatagcaggctttattattaaaaatcaaattttccttaacaaagtttataggaaaatcaaatttattatttttcttcataagaatactcctttccaacttggaataaaataaagagagttagtttaaactaactctctaaaatctttctataaatctaaaactttctaaattctctcgaatctcaaatctttctattttagacttcttgatattttgaaactgtataagtcttagtaaatacttatgcagtggctttccatctatttttttattttttgctatataggctatacctaaaggtaaagcaacgtacttatatataaaatttatgtgtatcccaattgtagcatctataatagcaattattattaatgccacaacaaaataaactgtagttgttataggaactggaaatggtattgtagtatttcctaatctataaattttaatttcaaagtttttaagcttattatagcttcttaaaatctttctatcttcctccataaaaatcactcctataaacctaatatggtttttacaaagttaccaaaggacttcattaagtctggttgagctatcattataattacgaatccacctacaattagaacaactaatatacctgcaacactctttttagcaagctcttttattaataagaatccaactactacgaaagatataggtaataaaatattatttataagattactctttatactctcaccatttatatctgcataagcataagtgctataagttgtcataaatgataataatgctacaaaaaaaccttgtattctcaacttgtttaattttactttctctgctgctttctcttttaaattcttaaaatttttcataataaatcctcctaattattgctcttattatttaaatctatatttgaagttcttggctctaaagttttaactaagaacttgtctccttcttgaactacagtaaggttaaatccttgttttattgaatttctaaaggaatctatatttaagtctacaattgccaagaattctttatcactaagcttataaatatttattctatcgattttattgaaagagaacttttaacctgctcccttaatatctgctccatcaactaagaaataatctatttgtgtttgattttgctcgtaatatgccttaaagaattgagatacactatctgtaatctttttagttttatcagcatcattttcgctagttccggagaactctttatttttgaaataagctttctctggtggagctgtcattactggtaatgcatccacggccatattcatatctttatcgaaaactataggaacttctaaatagtaatcaactaaattagtatcatactgaagttggtcctgtggagtttcttcttggccagctttaggtgtataaactcttactctagctttaacacttacgttaacttgattttcagaatatttttcaaaataaaaagcactagtataaatgacatctgaataagttccattattcatctcatttgctagttgctctgtagtgtactttgttattctatttataaaatcttgtgtattaattggatatctagaaaaataatcccaagcaaattcttcagcaaaagaaaaggcttgagtttcaagtgaactttgcttctccatattatttaatatcttttcattttctttcttcaaagcttcagattgattacctttaaagactgaaactccatccctaaaacaaagaatacctataagaacccatataaaagctcttgctattctaaatggcattacacttactaattttttctccttaacaccattaacctgcttatctaaattagcaactgaatcctcaagatccatgttaagtttatcttttttcttaaagaaagactttttttctttattctcttttttaggcttagtattttctttattctttctaaacataatcctcactcctatctctaattactatgccatagtaattctttttcttttctttatctttgtaaacatcaagatttacatttaaattttcttttcttgcagaacgacaaagctctgctaatgccttttcaaaattttctattgcactatttttcattttcatcacaccctttgcctataaatacaccgtctattttaattgactctaaaatctttaactgcttttcttcctcaaaacgataagcttcaaagaattcaatttcattatttatttttataaaaaaacttgctatacaatttaactctctagctctatcatcgcctagcattaatttagagttacgctcattatgtctaccacaaatcttaacttgaattttatttattaactcagtgtttaattcacttatctcattatcattgattattaaattaatacctgtatccttagttgaacctattaatttaattaagttcttctctatgctttctacctgtatttgctctatcgaactaatattagctttctttaaaagattataataattatcaataataataacttttctctttaacttcttagaatcaaatctattttcattgaaagctccaaaacttttaaatccatcttcttctaaaattaaagttcttctttcttgttcatctagtaactcatttaatagattatctaaactactaagctcattgatcacttggcccatcatactatatcttgaatcaaactcataaaagccagataactcaatcatataaacatctgactcttgatttacaagttgccaaataatatttttagtaagcaaggttttccccacgcccatttcaccagctattaatacattttgagttttatttaaatctaacttaataacagaatcgtcaaatcctattcctaagtttatagctccatttctttcatctaaataattattgctccaaggtaaaattttaggagcattaaataatacccctaaagctttatctccttcttttttagcataaattatattactcttatttcttttaaaaaacatactgctacctcctattattcataatcatcatttatagttgattttagattttcagttttattttgttcttcaaaattttcaaatttactatcatcttcattttcaatatttgaatccatagatttaacttctttaatttcaaatttttcgtttacactattcattaaattatcatcaattaacttttctttatttaaatctagaccaactttcttatcttcaatttcatcttttcttagctttaaaattttattaggtataaaatgtttatcatcatcaaaataaaatgcttggaactgtactgtatcagctcctagcttaaataaaaatcttcccttaacttctggcaaatcttttgccttagtattacttaaaacaatttcagaagctttagagtctgcaaatctaccacaaattcttactggtacgttgtttttaatttgccctgtaattacctttgcatctggtctttgaactccaatacataaattaattccagttgctctagataaacgagccaatgtagatgtatagccttctattcttactaacttagctctagtttcatcatcaacacccgtcttatccattaactctgctaattcatctataacaacaataattcttttaagttcttctccttcaaactttttattgtactcaccaatattcttagaaccactttctcttaaaagctttaatctctttgcattttcatctactaaatacttaaataacttttctgcagcatcaacttcagttattacttgccctactttttcatattctaaaccaaattcaactccccccttaaaatcgaccatataggctattgcaccttgttttaatagttgccaaagtatgcatcttaaaattacagatttacctgatccagtttcccctgctgataaaatgtgagggcttttatttaaatcaatttttatatttccactaaaagtttgtccaacaacaactaccccttcttgctcttctatatacttatcatcccacaatatttcttctggtatcttagcatctccagccatagattttataattacaattcttttactagctccttgctctattgaaattatagaaatatttaatgatgtttgaagttgtggaatataacttttccaagtttcaataggtatcattgactcaaaggttatttcatcaattctagtacccttatcttcaatgaaagactttaaaatcggtgttttagaatctgcaccaacaaagtttaattgttcaaaagcaagtctatattctgcatttcttttatcttccttattcttaataaaagatactataaccatataaaataaaggagctataaaggttgaaaaatatattattttaaaataaaatttagtgtctacaagaaagtaatcacttttaattcttgcagctataggaattaaaaaacttaaaaagaaaccaataaaaagctttttattcttccatgattttttaaagcctaatccaactctaaaaaagaaaattcttagaacatttgcaatctcatttataattgcatttgctccattctctatttcctgattaacttttttctcccaatcactactcaaaaaaatcactcctttctaaaaaaaataataaaaataagagcacttataaaaagcactcttatttaaactttaatcttactattcaaataaatcttagtagtgtcgcttctagtatgacgtaactttattctagttttatctaaagcctcacttcttggagaatcattttctagttcttctttgtatgttcttttagcaaatccccttctcagatcatgacactttattcccattttagtagcttgttcttgtaagtatctcatgtgtggaaatactctttcatcttcacttttagtttcaataaactcactaatgtttttagataaatatttattttcaagttcaatagaacaaagtttattacccttagcttctctaagattaatagttattaagtttttatcaaaagaaaagtcctctttctttagagctgatacctcgtgaacacgaagtcccgactctaacattaacttataagctagtctataatttttctttctaactctgttaacttttctttcaatatcaattaaatttttttctacagtaggtttacgattattcttttttttatttttaataatctcttttagttcatcttcagaaggaaaatcaacatcaagattatgctcttttaaaaatctaatagcattaacacctgcagataatttagttttaaatttaattgaatttaagttatctaaaattttatctttagtaataacagaaacatcatcaaggttattaaaattttcaaatattttattaagagctgagtttctatctctaatagaatttttactcaaagaagaatcagaataaataatatttttcatttctttttttaaattaaatatattcatttaattaaagtcacttgcctttcatggagagtttatacggaaggagtacactccttcctctggggggaatcttccccccattccccccttggactggagctaaacgctccagcccaagagtatataattatctataataacatatacatataaaaatattagtcccaaattaaaacacaatttgtgaccaatacattatatgtatatattatatatataatatatactctataatacgataaggaactaataatgatatatacctttaaaatacttatattaatacagggaacttttatatcaatttaaatttttaaagttccctgtaaagttccttgcaaagttccccctaaagttccctataaaattaacattttaaagttcatattttactctaaatagagcctttttaaaatactatatgagctatattttataactactgcatacatattttctccatctatttttatacgtttattgaacctatcttctgcacactcaatccattctaactctctccaaagatacaatttcccatcaacagtatcataatttcttttctctaacatactctttattgtttctgtatttacataaataaacttattgtttctactaaaaactaattgattttttttcattaaatagttaactacatcaactaattcttttgcatataaatttaaatctttcacctaataaattaactccttccgttcactttctacttcatcctcattgtaattttcatcttcaaaactttcaagattttcattactttcttgattaatttcttctataacttcatcttttttatttgagttttttatttcatttttaacacaatttcttatgatttttgtattcttagttattacttcttggtgctttttatttaaccaatctatataatctactccttgtaattttaataaatcttgtgctaattcctttaaatttttatctaactttgcagccataattttaatctccttccatctactttttagtagtttgttattatcaattctttatttctttttcttccttcagtttgtcttgaaactgaatatggtacttcaacttctttgatattaaaatccttgtaccagcttctagtttcttcacaatcattgattgttaggataaactttcctttgatatttttaagaatatctctaagttttaattgctcttttattccaaactctgctttatatccggctgtaccatagtacggcggatctaagaaaaataatgtatattccctatcatatttttcaattattttttgaaaatctaagttttctatataggtgttttttaatctttcttgaagctcatctaaattacaatcaaagattttttgtgatggtaatgtattagttccataaccataatgattaccttgaccaccgaaactttgagttataaggtacataaatcttatagctctttgtatatcggttaaatgctccaaagtagcatttttatattcatcgaatatacttcttcctgatatttcataggacagaagtcttttcatttctggagcatgatactttataattttaaataggtttggtatttcattttcaatatcattgattacttcaatctttgatttttcctttccaaaatacacccaccccgcaccaaagaatggttctacataacacacatggtctggcatcatttttattatttcttttcttaatttacttttaccacctagccttgtaattggtggttttaacattaatttttgcataaaaaaattcccccttgaacattatttaagttcttggagaacaactcgttttatatgattattttatttgtttagactatttaaaaaactaaatattttcttaaaactaatatgtttagtaaatcgtagaatacctttatcaccatataagtttactccatttttatttacagaaactctcgctccttttttacctgtactaaatcccacaccccctccagttgataaattaactttagaatttttaccaactttaaaagactttcttaaactaaatcccatatcttatttctcctttctttttaacttttcaaatatattttctatatgatctgcttcaaattctataattgcagctaataatttatttctagattgtatgccatattgttctttaagaacttttgcattatcatacataaagtccattattttatcattggcatcttgagttattattacattaattctctcctttgactcctgtgttttagcagtaaaaagaacatccttttctagttcttctcttatcgcttcaactttctttctaacttcgcctatctttctagtattcttattcataaacatttatttcctcctattttattttaagtaccaagttaaaattaactaattctccagttaaaattaatctttgtttagcatgattaatacaagttattaaagttatttctttcttgtcatttgaaaaatttattttgcttgtgtcattaggctctacgatatatcggtttgttattttatattcaagttccttattatcagatattatttttactgtagatcctattttaagattatgaaggtttctaaatatagatccacgcatattattgtgtgcagctaatattacatttcctaattctccaaaatcagaacttgacctgtacttagccactacataatctagattttcttctcctaaaactataggagctttaactcctatactatctatttctaatatcccaattacatcatttttttcatttttcttattgttattaggttgagtaaaagtatcttttatagcttcttttttctctgtattttcagttgtttcaggaatactataatttactgaagaattactatacattttttcttcgtatttttgaactaaatcatcctggattgactttgatttaaactcaataaataaagctgctcctattaacaatattccaattatgattaatgttataaaggcttttttcatcattttaaacacaccctatcactgtaaaataagctttaattaaatttattaagctaaaaaaaattaaatatatatttaacagacctaataaaactcttaaagctatcaaaaatacttttataaacttctttttaacttcatacctagaaaatatgaatattaaaaatatatttaatataaataagcctatactttctaatatcagtatctttatactcattaataccaaaggagaagaaaggcctataataaaaattcccaatataaatatccctaaaaacatcatccttgccacaatgggaatataattatccaaacctaatataagaaaaaaaagtcctaaaatacttaaaagaattcctatgaaagtaaaaaaattaataaaaaccatttttaaacagctatgttactgaaattaaaaaacttaaaatatgtttttatatgatattcaaagtaatacttccttaggatcttctcaagtttatatttttttcttattccacaagattttagatactctttcgataatctttgtagttttgaaattaaatattttctgtattctaggtcctttttatttaattttctatttgataaagagctaaattctaaatctaatctttctatttcatataataaggtttcactcatttttctcactcccttttattgttgaaaattatgttttttaaataatatttcaagttcttcatcggcttttttagccactttaaataaactcatatacataaaagtatttataataatcaatcctaaaataatagttataaccatacatcccatctccttatttttttatgtaaacttaagagagtaccttatggcactctcttaattataaaaaattatgataattttcttttttttgaaagtattaatgctcctaagcctcctgatactaatataattccaaatggaattaatgcattaacatcaaaacttgaacctgttttaacaatttcaaatttcttgttagttaggttgcacttaaccacttcaccatgttcccctattttaaaagttctagtttcagttgtaagctcatattcttctggagcttgagtttctgagattttgtattctccagctgctaattcaaactcatttccattctttgaagaaataaactcaataacttttcctttatctaagccagaaagacattcaatttttattttagctccttcaagaacttctcctgtagcaacatctgtcttagtaaagataagttttcctgtagttctttcattctttaagttggcctttataatttctccacctttaatttcaaaagttccaacttcagtagaaagctcgtatccttccggttgttgagtttatagcgataggtaagattttgatattatctctgtcttttcccccgctccacaccgtgcatgcgattttcaccgcacacggcgttccatctaattctttaaaagctgattatagttaaattacatttcttacgtagtgtatttagctttttgagctgtttcttatttagattaaacttgttaagtaattttgatatcgtttctatttggacggcatgaaccagtatgtgtatatccttatgaataataatgagattatcaaacttatctgtcccacctagagatataggttttatatgatgacaatgtatttcctcagctgataaaaacattttcgtgattgcacaccttccattctgtccagaatacttagatattctattatccgcgtattctgttctctcattcttataagatgattttaatatcttccttaactcatatatgatatccatattaagtcttctatatataagattgcgtccttgctctgtataattacataccttgtaattgaatgtcggtacttttttccattgcacatctactaatggaaataacggcatacctccgatgatgaaagtacgataattgtttttaaatagtttcttatataatggtggaggactccttggaatttcatatcttgctataaatcttaatctgttatacattgtcgagagtgtttgataggttatttcatggaaatccatatttacatgtgatactacttcataataatttcgtattcctaatatatatgagttgtatttcgtaatggtctttccattagaatttcgttgtatttcttgcactctttttcgtatttcttgtttaatcatttctttgttttttcttgatacaaaagtattggttacatattgttttcttttcaaccttacttttatttcaaatcctagaaattctgaccttttccttcttagattagttatctttgatttttctggtgatatttctagtttgagttgcttttttagatagcctttgactgcatgatatattttgattgcacttttatgtgttttggtaaatatcttaaagtcatcggcgtatcttacaatatacatttcttttagattggttgttctcaaagctcttgccaacttgccataactatatttatgccttgttctaaatgtttcccattgattacttatccaccagtctaaatcattcagtactacattagaaagtaatggcgataatatccccccctgtggtgttcctagttcaggagtacctattccttttattggtgctttcaacattttataaataattgctagcactcgtttatcctttattcctatgttccaaagttgtttcattaatcttgtatggttaacattatcaaagaaagatttaatatctatatctactacataatgatttcctgtcttgcttgctatgaaacaacatctagccagtgcatgttttgttgctcggtttgggcgaaatccataggaatgtttatgaaatctagcttcgcaaattggttctagcacctgcttgaacatctgttgaataattctatcacgcattgtaggtattcctaatggtctctttttcccattaggttttggtatttctactcgcctgatagattgaggtttatagttctctaaagtttcccttatttctttaataaattcttctttatttcttatcttgtagtcatcaattttaattccatctgttcctactgttgtagaaccagcgttacttttgatacttcgataagcaagttgaatattattttctgaaattatgagactataaagatctattccttttgtttgcttgttcaaacttctttcatatagccaatcaaaagtgctttgcataccataatattcattgtatcgtaattttgtactcaccgatggcatattccttttcaaataaattttcccatcatcttactcgaccctgtgagtttcatttaactttatcaacttttcaaagaactagacttggggctatccctccacgttaattacacgcttcatcagtactgtgcccctactttcatgaggacaaaaacacttcgttttcacttatagttaccgtcccgataacagtcgtttgagtagacgttcctcacttacaacgttccgaatattctagctgtacatatatccttaggtgcctgctataagcctgatgaattataccctcattgttaggtatcccgaatttcatatcaaagactcttactcttcggtatccatcgttgttttctaacaaccttactacctttcagtagcgtcgaattttagacccgtaccttcgcaggttcgtcagtcattttagacattctcaccatagatattttatagcgtcccgacatatcctttgccgtatgatatctcacttaggcattgttctgccgtctttacctagcttcatacacattcatgctgttacaatcctatgcatgtaggagtatcagactatttgtttcaagccaacatgatgactatcattccaaatatcgaatattcagttgtgattctctcatttaagaaaatcctcctttttcatgctttcacacttataaggaaacgtttcgcacctctaaattcatatctacctactggaagtgtaaatttattaccttctaaacttgaagtaaattcaaacttaacatgcttattttgctcatctaaacctacaatttcaattttagccccttcaagattttgaccagttgtaacatcagttttagtaaagtttaattctcctgtttgaactttattttctgcagttattgtcttagtttcaccatctttgtctattacaaaacttaaatcttgatcttgatttatttcatagttttctggtgctttaacttcaagccagtaatagttgccagcttctaagttttctactactatttttccatcttcatcagtagtataagttcctacaagcttttcaccattccaaagttcaaaatctgctccttttaatggtctttgagtatcagcgtctattttgataagctctacagtagctcttatctttttattttccataacaagttcaataggtttattattttctttaacatcaaagtaaataggttctgaatttaagacataattccataaggtgcttacttcatctattctgtatctaccgtactctaaatcatttagatttatttttccgttctctgatgttaagtcccaagtttggtccttcataaagccatctacacaagttattttaaaattaacaccatctaatgactctttagtatcagcatctacctttaaaagctccatatttgcctttatacggtcgttagacaccttaatagtataaatagtgcctaaatccttaatgtcttctagagcggcgttctcatcgattttaaaaggtactggttctattccaatatatccttccttaggttgagcttcttccaactgataatttccataatctagatattgtggagttataatttctccatttttatctgtagttaaaacttttgttggtataggaagtattccaacaaagtttttaaatgttacaagctcgttagtatcagtgtttctaacttggaatttaactccttcaaggggttgtccatctttagaatctgtttttactactcttaattttgccctgataggctcattcttaacgtatttaacataagtcttattatcttcagttatgttaattggatactctctatctgattgccaataaccttctggagtatctgtttctaagaatttgtattctccatatcttaaatctttagtataagcaaaaccattttcatcagttacaacatgatctacaactgttcctggttctataccattaacattaactgcaataacatcaaatccagcacctttaactggtttttcttcgttttcactatcaactttaactatttgaatttttccctttataacttcattttcaaagtcataggtgtaagttttgttatcttcagttatgtttatgtctatagttttatcgcttattttgtacccttctggagcttgtagctctttaccagtataatgaccatagtctaataacttacttgttgcagctccattgtcgtcagttgttaatctatcaacttcattaccttcatcatcaaagataccaataactgctccttttaaactaagctctggcatctctgaatctatcttgtgtatagaaactctaccttttatctttctattggcatgagtaatttctatagtttgcatatgctcactaatagtaaccggatattcttttccgttaagtacatacttatttggggcttttgtttctcttacaatgtagtttccaaaaggatgtaacccacttaatacctttccattttcccctgtagtcattttctcaactacttcgttattatcagccttcaccatctcaaattcagcacctgaaattggttcgccagtttctttatcaatttttgttatttctactcttccttttatttgagtatcaaccatttcagcagtagttactttattaggttttacagtaatattaactggattagtaattaaatatcctaaaggagcttcgacttcttcgatgatgtattctcctggcttaatgtcattgaatactactctaccattttcagatgtagcttcagctatttgattaccttctttgtttttcaaaacaaatttagcaccagttaaaagagaaccatcgtctccttttttaacaatctctatagctccatttaaaccagtccatgatacagtaacattatccttattcatattttggtatcttaaatcaacaagtgccatgtcttgtttacctgctactggagttgcataagctaaagaagctggtaattctacagttgctttaacatcaaccttaatatctcctgtttctgcgtctataggaatgtaaactttgaaactttcgttagaattataggtatttctttcatctccatccatgtcttttatcttaactacatcttttaatcctggattacttgaactttttatagtaaccttagcatctttaaactcatagtcagattttatttttataggctcagaaacgaaataatcaccttcttgatgagcaactatattactaggagtaacttcaaagaatgttggtaactctttgtttaatcctttttctactaaaaagtctattactggttttaatctgcttaaagatactgttccattttgaagtcttgttctatcaagtcccctacttaaaccagcttctttttgataagcccaaatagcaagttgagtacaatatctatattcatcagctgatatcccccattctgagccatctttagcagggtacccccaataaataatagtttctattcctccatcaactggtatttcttctgtgtaatcttgtccagttggattcagtgcacctgtatttagacaataacagatccttagatctggagcatagtatctatgattacctataggaagaacctttccccaagttggagaattgtaatttagataactctctgcatctgtagaatttatttctactgcaaatactttgatgttagtcaataagaatgtaaaaattaaagttatcgttgtaattagtttaaatctttttcttttactcactttctttctcctccatattatttattttttattttgataaattaatttaagatgtatcaaaatacttcattttcttttctcctttctaaaaatttgtatttaaaaagagtgctgcttaattgcaacactcttgaactttctaacttaaaccaatacttattcctaatgctctatttagttcttttatttcatatccatttagctttcctattttctctctcatctgatacctagaaatagttgttatttgctctaataaaatagtagatggcttttctaaacattcttttattattttagtatgtacgggcatttctttcttaggttgagatgttacagaagtcactacaaaagtttctccatacctattcccaatatcattttgaattacaataactggtctaatcccaccttgtactgaaccaaacttactctttatgtctcctaagtctgcatagaaaatatcacccctatagacttctcctttataaaaatctttcctcactcttcccatatgttctccccctaaaaaacagtatcaaaaaagatctagagtaaaactctagatctttatatataaattaatagtcaaaacctataactgtataatatcttccattactgtctttatatactgcacaagctccttctgttaaatctgaatctaacatattcttattgtgagctggagaatttttaaatccatttagaatagaactagctgaagtatatgcagttccatcataaactatttgaccaccttccggataacttttatggaagccactttgcttttgtgccatttcttcacagtggctctttgtccatccagcatatttaccactccagtttaaagcattcaatcccttagattgtctataagcattaaaatcattccaaagctcttgagtcataccactttgatattcccaagttctctgtggtttttctactggtttttcaaccggcttttgttcttgtggcttttctacaggtttttcctgtggcttttcttctggtttttgagaaggttgtggagcttcttcaggctttgactcttcaggttgctcttgtggtttactttcaggcttactagagctttcttccttactaggttttacaattgtaatacttccttcactacttgcagtagtgccttttatatcctccactttctcaaccttctcaccacttggttgttgtgaagcttgaactttattttcttgttttagaacctatagtttcaccactggttacttttatacttccattatcaacactctctactttttcaacttcaccttttttattttttatattaacatcacttccagcttctttcttttcttcaactattttagaaacatcgtctcctttagaactgtctgcgatgatattaccatctttatctttaacaatcaatgatccatcttcttgttcttctacagttacttcttcattgtctgtagctttattttcttctagctttttatcttcatctgccttaggatcttcttttttctcagctaaagctatattattagtatcagtagcataatgcttacttattgcatatccacctacaccaactactgctattcataaagcaactgcaactcctatagtttcttttttatgtacctttacaaattctattatggccttaattctcttattcattttaattctctcccttgaaataatattttttaaatatatctcgcatatgtaccaagttgtctaaaactttttcttaaaactaaaatgtttaggaacatcaaagggaactacacatccaatttcttcttcttttttaacactaaaatttccatgtccattatgtttgtaaatggaactattagtcttaacaaagtttctatcactcataaactttttacattctctatgagtaattttccttatttcttcatcttgtagttttttcaattcccttttagctttattatgttctttcaaatgactaaaatttcggttaagacacttataaatagtatcttccttagctcctaatattttagctatttctttccccgaaaaaccatctaaataaagacttccaactttatttttattaagttctcctttacctctcacagcatcaactcctaaagtttgtcctaaaagtttattaaaaaagggcgtagttcgctctccttttctcctactggacaaaacttaaatttaatttatttagttgtttaatactattgctctataaatttcttccatacttgtatcgtatattctagataatttatagacttcacttgcactagggttttttactttcccattttctaatttgtgaataaaacgtgcttctttaccaattaagctagcaacttctcgttgagaaagcactttattctttcttagaaagcttaacttgttttccatatttatcacctttatccatattttcatttaatttacctatatattatcacgctcactcaccaatgtcaatattaacatcataatataattaattatttgtataaatgaatttagatagtattaaagctctattttaaaaaatgttagattgttctatataaaattgctaaaactatattgaaaggaggtttataaatgattgaaattgaactacacaacttagctttaaacataaaagaatttcgtaaaaaaaataaactttctcaagctgaacttgctgaaaaactaggtgtagcaagaactactattggttattatgaaagagctgaagtagaaccaaacatatatacattaatacaattatctaagttaatgaattgttctatcgactctctactaggattaaatcatccaaatgaaaccacaaatgacttaaataatttagatctctcaaaaaaaatttttatactaaataagctaatagaaaaaaatactcaaagttttaacgatttagagacatctaacatcaggaacgctagaatgttcaaagagcttgaaatgtctaaaaaacgtactgaaagaatgttcaatgaacttgaaatgtctaaaaaacgtaccgaaagaatgttcaatgaactgaaaaaaactcgtaatagagctgaaaatgatattaaactatttcaggaattatctaaagaatttactaatactttagataaagaacatgaaactgatttatctgatgctcttgagtatcaagatataaattataatttttcaactactgaaaaagaagattttctttcaagtaatcttaaagacttaataagtaatttaaatttcattccaatagatgtagttggtgaagtttcttgcggaaccccatcatatgcatttaatgaaattagtaaatcaattgctttacctagcaattacaaggattgtttcgccttaagagtaaaagggaacagtatgaataaattattcaaggacaatgaattaattatttgctgcagaaataaaactcctattgatggcgatatagtaatagcttatttaagtgaaaataatgaagctacttgtaaaaaaatacataagaaaaaagataaattagaactacccccatgtagtacacttccatatgaaatacaatattatgacaaaaatagtgatattaatataatcggagtagttttaggatctttaaatgatattctagacttagaaaatatcgatattgaagatctggaagaaaaattaaatactatttaaatcataaaatttaatattaagttatatactcaaggatttatattttatatagagcaataaatatcattgctctatataaaaacattttattttgttgacaataaccaaaacaaacgattgttctcatatacatacgaacttctgttctcattgtatcaaattatctataaaaaaaatatggtaattcccaatttttaataaactggaaatttttcagtttatttataatctattttttaacaataaattctattaattgttaaattattaattaaaacatagattttcttctaggtatttccagtaatcctttgaataatttctttctgtaaagtttggtagaactctgttgttcgcattgttcttgatatattttctataatttgaataatatgtatctctagtgttctcaataactgtattaatataactctctaaaaatttaacagttatatttctatagttttcacttaattttgttaaaaccttattcttaatccaagagctcttaactcttgcagctttaagtaactctttaactttatttctaacatcaacaagacttgtacatttttcatacatgtctgcattaaatttttttgagttactattagaatctatatctatattattattcctagtatacataggagtagcttgattacaatctacgcttgttgtatcaagcattgtaatgttttcattatcgggtaatttgttgggtaatggcagaaaataacaattccttttttttacatttttaataataagtaaacctaaatcttttaatttatttactatattttttatttgctttaagcttatatttcttaattctggtcttttctttttcttcttatttacccaatcattataatctttatgaattttagaaaatgagatgctccaagatccattatttaataaaataccttttctgataaatcttaagatactttgagcttttcttctagactctttatattcgatttgatttaagacatgaaaatctctttcttcgagattaaaccttttctcttgttctaactgttctttagttaataagtgtgtgtatgccataaaaataactcctttcatctaggaaagtacactaaatcctaaatagaaagaagttaaaatttgctaatattacatttctattaaaaagtcaatagatatcattgacttttttcaatagctttgatatcataaagctatgaaaagtgaatatttcaaatagaactttgttctatttcggatttaagttcatccattaagtttactttgattggcgtcgtaggaaacttaatggatttttccttttccgtactatttaatttaattgagttaataataccatgttaaaaataatttttcaagagagtaaaattatagaaaattttactctcttttattttagcctcaattaaaaacatcacaattttacgtaatgacaatttgcttaaaataaaaaaacatcacaattttacggaaaacacttgatttagattggaaaaaatgataatattaaaacataaacatcacaattttacgtaattaagattttataagtgaaaaaacatcacaattttacataatagaaaggattgataaaaatgattttaggattagatattggtaatattacaagtattggtgtaggtgacaaagaagactttataactgaaagtagattaagagagtttgaagaattggatgattttagtgggaatgatattgttgaaataaatgataaaaaatttattttcaatgagggatattttgaaaataatgtagtaaaacatgaaaaagaaaattttataaatttattatattatactattgctaaaactttagataaggaaaatagtaaagaaaatgatgtcaagatagttataggtgttccagcagggcaatataactcagagaaagaaagactaaagaaagttattttaaataatcaatgtaaaaatataaaaataaatggagaatcaagaactattaatatagaagatatatttatagctccagaaggatatggggctaaagtagaagcattacaagctaaaaaagaaaaagtaaaactattaatggttgatattggtggaggaactagtgacgctgctttatttgatgaaaatggaagatttattggtggaaaaagtataaaagttggattattagatttatataaaaatgttcaagaagttctagacttgaaatataaattaagtgtaagtttagaagatgctagaaaatattttgatggagaattagatataaggaatgaaaagtttgaagtagaaaatacttataaaacagaagcattaaataagttggttaaatttttaataaatgaattaaggggattatatcctaatatatctcaatatgcaatatgtctttgtggtggagctgctggtagaatattacctgtatttaagaaagtatatattcaagcagaagcaataacagatataaaggcaaatgctaaaggtttcagaaaggtaggtcttgcaaaatggcaaaaccaagggaaataagaataacatttaaggaaaaggaagcagatctttacgattatatacaagagaaaagtagtgcaagtgcttttttaaaagatttagctaagttggagaaaaaaaaggaagaaatatatttgaataacttaatatcttctgatataaatgataaaattttatcttcacagaaaactaactctatagaatacaaggaaaaagaagaaacttttgttttacctgatataagtgatttagaagattaaatttaatactatatgtaatttttataactggaaattttatttccagttatattttttttaaatactcctaaaagtctttttctctttttttttatttgtattgagtcaataacaagtcttaaattgttgacttcttcatataattctttaaattcatgatttttttcttcaagatcttttattctctttaagttattagttataacattatttaaaatagttatttgattatcttttaattttatttgattttgtagaatttctatagttgatgtaaaatcagtattttcttcagtttttacatcaactatagtattgttttcttctaatgatttatcttcttgttttatatctatatttttattctcttgttgtttaatattatttcttttatttttaatttcttcttctaataatttgaaaagttcattgcttattactacttgaccaccattctttttaactaatggagaaaatctttttttctaagcaaattataaacttcagtcctggttaaatctaattcatttgcaacttcttgagccgttttcataccctaactccccctaatttaagaatatataaataatattcttgaaaattatggaaaatcctttattaaaaattattcttaataatatttttaaattctttctttaatttatttttatttaaggctctatttataatatgttcattcctaaattcatttaaatgtctatatatatgtttttgaatagcatctttagaaaagtcattatttaataatttttcaatttcttttacatttaagccatttctataaagaattttgatacatttcttatcttcttctgataatctcataaattttctcaccccaatttataattactatgggtataggatataattaaattgcataatattcttggttgactctaaacacaaaaaagattatctctaaaattaaagagataatctttttttgtgttaatagatatacaggttaaattaagtttgcaattaatttaatagttaatactggtttaactagtgattgataaactcgaaagtttctaatacattattacagtaaattttaatattgttaacctattttaacgtttcttttatgttttttcaagtaatatcagaaaaaatctctataaacaccaataatcttccctaaaactataggatcagtatcatatacctttttataatctgaaaatattttttttataaaggtgcgattttcaaataataataatcctatactatccttttctagagaatttactttctcaacgataataatgtcctcaggaaatatattatctacagttactatataatcattagtaactttcttaggaaatacatcattattattattattattaacttgtttttttgaaaatttaattagatttttaatagtttcttctgatacattttttttaatctttctgtttaaatcaataatatgaatactcctttttctacctctttgttctcttttcccaagttttattaatccatctttttctaacatttctaaatgtttataaacagtagatgatgactttaaatttactgcatgagcaatttctctaaccgtaggttgatatcctttttcttttataaaatctattaaaaatgtatatatttgttctctttttttcatgtgttcaccttataaaaagaagtagctttttattacttaaagctacttctttattctaaatttatattaaaatagcttgtactctccatcatcagacttatagtatattttagcatacttaagttcattaaggcccttaaaaagagtaaattcatcaaatacatccaggattacatcaggaatttcataatccttttcataatccggatcatcttcagatacagcatagttatctcttacttttttaccgttattataaacttcaacattaatcccattcattatgctatacatacttaaagctcttgcaaagtcaattctaaataaaagctgcatatttctatcatcagtttctatataatcccttattaatcttgaagcaatatcctgctcatgatctgcctcaaatattaggtcctcaaaaactaatacatattttctatttgcattatctatactatcaattttttgtatccactctttttttagtctaggagcttctctttctaaatcatctcttgttttaactaaattcatacttaatacacctcttaatatttttactcacattataactcgaaggtattatatgtcaatatattttcaaaaaaacatttacatatttttcataatatattataatatgtataacttgaaaacgttttaactaatattaataacaattggggggatattatgaaaaacaaatacttattattaatctttattttatttatttttagttttggaactataaatgtagaagctaaagaaagtaaaaatttaataaaaggagaaatagtattagaaaactttaatattgatggtaacaatattaaaaatgataaaggggaacttgtatttaatattgatgaaaatcttgaaaataaattgaatttgataggttttaatttagatgagctaaaagaagttaagttagtaaaagatgaattatataatgaaaaaaattatattttattaaataataataaaactgttagtttaacagaaaacttaaaaataaaaaatattactaataatgagattatacaaagtaatttagctactaaggttagaaaaaaaaggagcttaacttctgaagttaaggaagatataattattaataatataaaagaagctttaaatttatcaaatgaatacaaaattatacaaaatgaagacttcgatgaaaatatgaaaattataatatttgaaaaacaattgcctaatggagtgattaatccatatcaaggagtaaaagtttttgtaaataagaacaataatgaaatacaaacttttaatatgtttgatgaagctccagaaacattagaagtaaaaataacaaaggaagaagcaagtaatatttcagaaaaaattttcaagaatttagataataaagaaagtaatacaaataaaacttctacccttgaaataataagaccaaactatttttggagcgatgaaaaaggagaatttttagataatccagttgattttgtaagacaagcatgggtaattaatgacggaaatgctaaagtgtatgttgatgctaataatggcgaaatattaggcggagatattgaaaaaggaagtgatcatgctaaagctttcggtcatgattctgtaaaacatagttataatagtgctaaacttgctgaaagtggttttagaaaattaggatatattgtagaacctacttttactacatctacttctaatatgagaagtgctgtattatcttatttaaacaaatcaacaagttatggattttatataacttgtcatggagcaagtgatggaagttatttatcaggtggcgggggttggagcttgtaccctagtgatataaaaggaaattttcatttagtatttttagatgcatgtaatactgctaaaagtagaaattgggcagatgcatttagatgtgacaatcctagaagaagttatttaggatggaaatacagtgtaggggctgaccctgcctataaattttgtcaatatttttgggctagagtaggaagtaagccaatttataatcttgctttagatgcagcagcatctgttccaggaaaaggaacaacacctataattcattatggtgataagagttggtatggttgggcttattaagttgggaggtaatctatgaaaaaatttttaaacataagtataataatctttatactaataagtttttcattagttggttgtaaaaatattaatgaaaattcaagcaatactgcatcgaaagatactgaaatatctaaaaatttagatttaaaaaatataaaaattccagataaaattattttttataacaataatgatgctatggaaataacaaaagattctaaaaaattcaatgatatagttaaacaagtagattttagcttaggtggaatacaagatagtttaaaatgtgaagttaattttgaagaagaaaagaaaggaaaattattagagcttgacttctcaaaagaagaaaattttatttataatagtagtattggtgaagaaaaagaagtttataataaaatctatataaatttaggattagaaaaacctaatcatttagatgaattttgtgctgcaagtttttcaaaagatgataataactatggagctttatttggaaatgtattagaatatgagaaattagtaagtactgtagtaaacaactaacataatcaattgtatccattaagtcaaaaaaagtatcacaagtaaaaatttgtgatacttttttatttataaaaacttaaattttattttctttttcatatttatttattaagttataaaaagaatttttctttaaattcattagttccatagcctttacaccagtgatttttttagctttccatttatcatatacttctttaaaattacctggatattctattcttggtctacctaaatgttttcccttagcctttgcattagcaataccttcggcttgtctttgcttaatctttactctttctttttcagccatatagcttaataattcaaatactatatttgatattaaagttttttctaaattacttttaccttcagtatttagtataggtgtatcaataacaactatatttatctcttttgcctgcagatcattccattcttctttaatttgtgccatgtttctacctagtctatctagttcttttataactaaaacatcaccacttcttaatagctgctccttaagtgttttatatccttctctattaaagtcttttccactttgcttatcagttattatgtctctttcatttacaccatagtcctttaaggcttctatttgtctatctaaattttgctctttagagcttacccttgcatatccatagagtttactactttctatattaattacccgtaaatctttgtccttacctgtttcaatataactttccataagaaatttactgctaaaggtttgagtaaattttttatctgagtcaccatatacataagttaacttataacgcatttttatcactccatatttaaattattactttaagtatagaaaaaacgtttattaaaatcaattagttttaataaacgtttaaaaataaatttatatacatttaaaaacgaaaaataaataaatcaaataaagtttataaaggttcacttttttaataataattatttctttgactttttaaatattattaattattgaataataatagtaattgttctagtattttattaaaataattattatggcttatttattataataaaataaatagttttgatactaataaataattatattttttaatgcttatataaaataacttttattttagaaatactatatgtataaggcaagctcgatattttataatttttactataaaatttaaacattatatttataatgtgttttaaataaaaaaactatctctattttattaacttttatcataagctttattaattaatttcaaatatacttaatctatgattaataaaattattcctaaattaatcaaaaagaataacatctttagaaaaattacttttactaatatttttatagtatttagttgctttttagtatgtttattcggtattttaaatcaattttttgtatataaatgtatgtagttctgacgtataatattactagtatatatttaaatatattattaattacaatttttttagcatatattgttaaaaatacatacgcatatatagattttattgctaataggtagcctaatattaaaacaaaaattttaaaagtataaataaacataaattttttctttcaaaaataaaactactaatttgaaaatttaatataattaatttgtacatttatatttatataactactactaatatttagtgttaaaaattatatttaaagcacaatcatattaaattttataatttttttaaagataaatacttttttagtgaagatttcgctgaaaaaattcgactttttactgttccaataggtatattttctataactgaaatttctttcaatgaaagctctttaaaataatgtaatagtagtactcttcttttgatatcaggcaatctatttatcccattaaataattcatgtaaatcctctttttttaaagctaattcttctggtaattcattttcagaaattaaattatttaaagaatcaaaatcataatatgaagtattttgtttatactttataatatattttattttagtattaatcttgttaattgttatttttctaatccaaacttcaaaagcatctatattttttagactacttatacattttattacagatagaaatacttcttgtgttatgtcttcagcaattttttcatctttaatcattttaagtgataaaaaataaatctttttatagtaattttcataaattatattaaaattactaaaatcatttttttttagttgttttattatttttgtttctattaaatcttccattagcttatcctctatttttataaaacttttaaatttatattcctatactatttttgcaattttcaaatcatttattaagttaataattgatttttcatcattaatatttaagatataatcaaataatttattaaaatcttgtttgtttgaacttactataagtaattttttttcttcaattatgcatattatttttaacatttcaactaataataatctattagttaatggcaaattattaattttttcttttaataataattttactatttcatcaaaattaatattataataaattttatcatcatattctaagagatatttattaaacactataattctcacctcaaatcatttttataaaaaaagtattaaatcaaacaaaaaggttcatatttatttaaaatttattgaaaaattttaaaataaatatgaactttttaatcaatacgcgttataatataattatttatataatatattaaaaaaagaagaataatgacttgtcataatgaattaaaaattgatttttttatcgagtcttttaaaagtaagtttttaaatgtaaatacattaataatttacctttaaaagaaaaagaatatttaattttatcataattaaagttgtttattgattaactttttgtattttatttaatacttttatattataaagattagtggaggaattcatgatgaatacatattatgatagcgaatttaagttacttaaaaatattttatttaaattatatatagaatatggattaacaaatgatgtatttgaatttagtaaatttattgataaggcttttttagatttatcaaaaatatcatagcaataaaaaatgcacatttttttactagtcataaacttttttagtttatttaaatttgacaactaaatatattatttattatacctgattaacatattaaaattatttttataatgtagtctcgcatatggtcgtcaacataagaagccttattttctataataatgtatagtatttaattaattattatataaaatgaggcttaattttataaataaaaagcttaaatatttatctaaaagcataaaagaaagttttgatattaatgaaataaataagatagcaaaagataaaaaattcattcaaagacaaagcagtataatagctaaagattttttgaggtttaccatgtcttatggatccgatatctgtacatctccattatcacaactagtttcaaaatatgatatgttattttctaagcagctatctaaacaatcattagataaaagttttaataaacactcagttgaatttatgaaagaaatatttgttaagtttttatattctcaaagtaatacattaactaacttagaatgtactttaagaacatattttgatagagtaataataaatgattctacaagttttattttgactaaagagtttaaaaagaagttttctggtttcgtaggatatggttctccatcatcgataaaaatacagttacaatatgagtcattaaccggtttatttatgaatatagatatatttttatgtataaaaaatgatgttgagtatttaaaaacaattaaaaaatataaatattataaagacttaaaattagctgatttaggctattttaaaattgattatttgaaaagacttaataaaagtggtacttattttatttcaaaaataaaaagtaatacttcactatatatgaaaaatccaaatcctgaaaaatataaggttggaataataaaaaagtctagtgagcatataaaaatagatataattaataaaaaccttatgttattaacataaggtttttattaatttattattttaattttattatttcttcttcacttaatccagttatttttgaaattaatgatatttctaatccttggtttaatgatgcctttactaactctaactctctttctatctttcctttagcttcagcattttctaaagctgatattctatcatatattgccttttctctcatgttatactgttctctttctttactatccatactaagcctgtataattcagattttgctagtttaatttcttcattacttaattctagttgccttacagtattactttctggttcaactaagaactctaaccatttttctagagcatccattttttcaacattttcaacatactctttattacctatttcattaaatttaggtaattcaatgaaatgtatttcttgaagatctgtaagctcctcatttgaagttatttcttttagtctatatgcattatgatatttatcattttttaagtatttaaaatttaagatgtttatacaaacagttctttctaacttactgtagttatctctattttgtatttgttctgaatacatcttactccagtaatataatgtcctttgtatcatgttatattcattctttacctggatttcaatatttatatgttccttattgctagttgtagcctttacatctaatctactaaatttatcttctataaaatctttatctatatcgttatttttgatttctacatcttttatgggagttgttggttttattactgcatttaaaaagttaattaatataggtttattcttttctgtaccaaatatctttttaaatacaaaatctatttgtggatttagtaatgttctatataccatttaatttactcctttcaatagttatactctaattataatatagttttatctaaaagctctaattaaaatctattttttaaaaataattcagctttcttcagaaaaggtatgtaggttacatagtatttattctttactaaagatattatcaataataaaaatacctaaaattaaatttatataaaaaatatatattaactttcttttattaattatatattagtacttattaatatatttgaaatttctttctgagttttaaaagctttatttatataataatcacaattatatttaaactcatcccaatttaccataggaacatatccagattttatattctttgataaaattctaaaaagcttattatgagaaaaataatcataattattttttttatttggtaaaattatagctaaaattgcatttgaattaatttccataccattttttaatggttttttaagggaatataaaatttcccaaggtatccactgatctctttcacatctatataattctttcatattaggagatattaatataatagttaatgaagtattatatattttatatttaagcttttcccatatataaatataatttttatttgataaatcttcattcttttgttcacctttatatacgtaattaattctatttttaaacttattttctatccaaattacatagtctattactttaggtaaccctttactaatatcatctacataataaacatcatattctaaatgcttataagatataaatatattcattattataaacacctcatttaaatttaatttttatataattattttatatgaaaaatagttatattttccattaattacatattataaatttttcaatatattcccagtaatcttttgaataatttctttctgtaaagtttggtagaaccctgttattcgtattattcttgatatattttctataatttgaataatatgtatttctagtgttctcaatgactgtattaatataactctctaaaaatttaacagttatatttctatagttttcacttaattttgttaaaaccttattcttaatccaagagctcttaactcttgcagctttaagtaactctttaactttatttctaacatcaacaagacttgtacatttttcatacatgtctgcattaaattcttttgagttactattagaatctatatctatattattattcctaatatacctaggagtaacttgattacattctatgcttgttatatcagtcattgtaatgttttcattattgggtaatttattgggtaatggcagaaaataacagtttcttttctttacattttcaataataagtaaacctaaatcttttaatttatttactatattttttatttgttttaagcttatattttttagttctggtcttttctttttctttttatttacccaatcattataatctttatgaattttagaaaatgagatgctccaagatccattatttaataaaataccttttctgataaatcttaagatactttgagcttttcttctagactctttatattcgatttgatttaagatatgaaaatctctttcttcgagattaaaccttttctcttgttctaactgttctttagttaacaagtatatgtatgccacaaaaataactcctttcgtctaggaaaatacaccaaatcctaaatagaaagaagttaaaatttgctaatattacatttctgttaaaaagttgctatatatcattgacttttttattaagctctgatactataaaaatgtaattagaaatttgttctatttaggatttaggtgtatccattaagtttcatgacgtgcaattaatcagagcttaatggattttccttttccatactatttaatttaattgaaataataataccatgttaaaaaatttttttcaagaaaataaattttatttaaaataaataagcgcatatcaatttaagttagatgtgcgcttaaaaattagaatattaaattattttacaatctcctttcttaaatttaataaaaataataactcgattggcatgagtagtttagaatttattataaactattttttttaaaatttaaatagtaacttgtaaaaaatattactcttcaggaatccatgattttttaaattcaatatctttgaataatgctgtaagacctgtaatttgttttaaccttaaaatttcatctttatccattcctaaatgttttgatatccaagaatcacttctacctatttcatgaagctctcgtataatattactcattaaatctatatcatgtgaacctcttgcacgattatgacgtattgtacttgccattcggcaatctaatggtttatctataatgacaacaggtatttttccattttctctttcaaatatatctggataatcaagcataattctatatctatgaaatccatctacaattatatatttgtctttatcacttgaataataacatactataggctgagtataaccatcttctttaatactatcatataatagcttcatttctgggggcgctacagcattaggattatatgtatttggaattattttattaatgggtactgatattatattataaacagggcttttaaaattcattatatattttctactcctttatatttttttcttattatatctatttttctttgttcatcacttttaagtccaaatcccataaatcggcataaatgatcattttttaaaatacaataacacattcttttccaagaaggaatatcttttgagctttttatatcatctgtattatctgggattttttgcatgaaaataattctagattttttatctaatgtataattagagactccatttcttttaattttatatccattttttataagttcattaattgtttcttctgataatccaccccctgttttatgccaaaattttatagaagaattaaatttttttatataactatttctgactggtgttggaagtgtagctaagagaaattttgtatattctttccaactatatccttctggaagagtgatatttctatatccaatagctttagtttttccataaatagctgtaaagttaactccttgaactcttcctacaagtttagtccaagtttgaggttctaatattctatataaatttaatgactcctttgcataatcattaaaaggagaagctactctcatttgtcttggttttaatccagctttatagtataaatcatataatttattatatttatattcaaatttataataggccgtccaaatatcagatactgtccagtcatataatggtgaagctgtccaaacatctttaaattgtttagatatccaacattctcctttataaccatttttgttatttaaaaatccgctatatctttgaagggactcatctgcacgaattcctaaaaggcaaacggtctttttatttccatgaatttgtttataccatctaccaaattgcttagctaaattttcttgtaacatacggtattcatataaataaaaaggattatttttcatatgaataacataaggtttattaggaattgacctaatccaaatatctttatcattatcatcccaaggataccaatataactgataattactaagagcagttcttactgccataggtaaacatacccaataaggttcaatatctgaaatatatttttcgaaaatttcttctataaattctgttgttacttgatattgtgcttcaaaatcttgatgaaatacacctattttatgggttaagttatgtttttttttataatctattaaaaggtgaagtaataatgtactatcttttccaccactaaaagaaataaagatattttcaaattcctgaaaaatgaactttaatctttgttgaagtgcttcataaacatttatgttttgatatatacgtttcaatttataattcctccaaatatgattattttattactattttaaattaaaatttttaaataagtcaaattttttattaaatagtactaattttaataaattgatatatttaattaggtttattaaaaataatagtaagtaataaaaaaatatagaaatagattaatatattaaatctatttctatattttgagtttttgaaatattaattaatttcatatatatctgataattcgattgatagattatcagtactttcatacttgtagttttttatatatttatcatttaaaatttgatttggtagtaaaatttcaaaaatacttcctttgtttaattcactttttatatttatatctccattaattgtatttaaaagagatttaactatatttaatccaattccagatccttcatttgaatgaataaaagaattattagctctaacaaatctattaaatatattattttgagtttctaaatcaattccacatccttcatcttttacagaaattttcgtaatagatttttcaactaagatattaatataaattgtactatttttttttgaatattttatagcatttgataaaatattcaataaaattctttcgataataattggatcacacattatataatgctcttctttatttgtatcaaattttatagataaatttttggataatgcaaacggaattattgaattacttatatcttcaattaatagaattatgttataatttccataattaggttttaaagaatttaattctattttagataagtcaataatgttatttattaatttaatcattcttttacagtttaactttaatgaaacagtatatttattaaaaatttctttgaaattaacattattattgttgttaaaattttcaagtagttgtatggttgaataaaaaatattaattggtgtttttagttcgtgtgatatattagatataaattcatttctttttaagttttttaatttaatatttttaaatgtttttcctaatttattattattaacaactatataactcactaaaaattcatccttattatttatatttaatttttgaatataacaatctaataattcattttttatagaatttttaataattccatgccagtaaactttattatttaaatcatcaaaaatttctttaagcttactataaaaatatttattgtttattaaatcatttttaaatttagttagttcttcttgaaaattatagtattctttaatttttttattaacataatatatattaatattataatcacaaataaacatattactatatttattattttcaactaaattaaaaaatttaattaattcagtatttaatgaattatagttaatagttgtcatatgtaatgaactttctatagcaagtattgatattaaaaaaaatattgaaattaaaaacgctgataaaaaagtaatatttaagtccatgtatattattccataaatttcatatattaattttaaagctaataaaaatatacttatactaaaatatcttaaaataaaattattaaatttagataattttaataatttataagaaatatatagatataatattattaaaaagctactaaataaaataaaaagattttttttgtttattaatatatattgtaatttaaaatgtatttcaaaaaaagaaaaaactaataaatataaactaataaatataattgcttttttgaagtttttacatataaatttatgtaatttactattagggaaaatagccactagtaataaaaataatattaataatgatgttgttattgtaatgtaattaaaaaatgataagttttcataattaaaaatgaaataatttatattttctaaaattatttctaaagaaaaagagaagtaaattaaacttaatataagaattatactatttttattatttaaataaataataaaaatacaatttaatgataagattgataaaatcatatttaatatttttagattaaatatagcagaatctaaaaaattagtatgattttttaataatattacagtaaataataaaattgtagttgtaattaagaacatattatttttaaattttaaagtcatagttatatctccaataagtcattttactaatatttatggtatcaataaattcaagaaaaaaatgtagaattttgtcatataaaaattaagatttattaagatttatgtaaataaaatataaaatataagttagaaaagtctttttgaaaagaaatattaataaaattaaaaaataaatttgtttaattttaatttttgataaatatagcctaatataaaatttaaatatataattaatcttatattaggctatagaatttatgtatattatattaattttattaagttaattatttatcaaagtctactacatgtaacaatttagcatctgcccaatctgcatgatctgcagcattgctatttccaccatctttagctattaatttaagttcacttactccaactattggaattaaaacatgctttcttggagtctctgaattcataacaccactatcaaatactttttttccatcagcataaacttcaaaacttaaagatgatacatcagaatttctcatctctctatctacaccaacatatgcttcaaagaacttataatttccatcagataaatcatatactattgttgaagttgcatgagttccaatacccttcttatactccacttcttgtccatcttcaccaagtaaagttatggtattattttcaacacttttatctttttgtacacttctccaacctgaattagctgatttccattctttatcactgatataatcataagcattaacaactgatacttttctatctagtgtagttttatttccatgagaatcagtaacttcataggatactacatagttacctcctctttttgtatttacattattatttataacttttatattctttgttatgtttccatcttcaggatcattagcaaccattccttgtaatgggtcaaatgaatcacctatatttaaggctacctcttccccagttaatattggtttatcgcttgtagtataaacttttgcatctgcccagtctgcatgatctccggcatttccatttccaccatctttagcgattaatttaagctcacttgctcctgctattggaattaaaacatgctttctttcactgtttacattcataacaccgctatcaaatactttttttccatcaacgtaaacttcaaatattactgatggctcactagcgtttctcatttctctatctacaccaacataagtttcaaacattccataatttttacctgataaatcataaactatctctgagtttgcatgagttccaagacctttattatattccacttcttgtccattttcaccaagtaaagttattctattaccttcaacgcttaaatctttttttacatctctccatccagatgatgctgatttccattccttatcacttagactttcagctgtagttattgtgtatatttttctttccttagtaactgtgtttccgtctttatctgtaacttcataaactatagtatataatccacctctatttgcttcaaaatcacttgattttatttttatgcttgatgttaaatcaccatcttctccatcattagcagtaacaccatctaatatattaaaattatccttaacatttattactgcatcttcagtttttattgtaggttttgcattattagttgataacttagggtttactattataccgtggtctgatgtattcccatttccactatcactaacttgtatttctaacttattaacgcccttaactggaatatttatttctaccatattatcgttatatcttaaaaccttagttgtttctaatgtatttccatctgctataactttaaaagaaatacttgaattaccgttagctcctattgtttgatcaacacctaataatgcttcaaatctatcataatcttttcctgataaatcatatacaacttttccattagcatgtattcctatacccttatcaaaggttttaacttctccatttactctaccttttatatttgtatttcttcttggagttccccattgagtttctactgattcccactcttcatctgataagtaatcatatgagcttacaacttctacattcataactttttctactttaacatcattatccattaaagtatatttaacttcatacttacctttttcagctgtatttacattgctttctatctttatattagaacttatatcttctcccttataagttgttcccttcacataatcagcagggttaaaatcacttcttagattaacaataatactttcttgttgtatatccaaatttggagaaaaagctttaatatttacagccttaccagttgataaatccttagcataaggtactacatcataacttgaattttcacttaaatcaatatctttgattacaaaattattatttatagtatatcctataaccttaccatcttttaatatctcatatcctaataaatcatctctattttctgaatctatttcaaatgatagagtatttgttctttcttcttcatttactttagatttaacttgtactttaagattttcattaaatccattacctttatagtcgtaagctgcaccatataagtattctattttcttatctggttttggtaaatgagctactacatctttcatctcttctgttacttctatataattccatccttcaaagaaatctaataaatcaacatccaaagctaatgaatatgctacagctaatctttgtttatcagaaccttttatagattttatttgttcagtattgtttctaacataagtagacatttttgtataagcatcatatccataggctatatttatttgagataatacacctaatctttcaaaataattcattgcgaaattttcacctttgaatctcttcatcatttcattccaattagatctatctccacctactcctttgattcttctatactcttgagcataaaggttatttgttacttctccatctacaacatatttagtattgaatatatgaccaaattcatgattgtaaatccaagtatcattattcttatgagttattggtaaaactatttgcttaaataaaccttcatctctttcagttggattacttcctaaatatcctgtatatccatggtctgcatatcctaaaggtacacctaaaaatactcttgctataaatttattagggaaataactatttttttcctctgttgcatctttatcaaatccttggaaacgttggaacatgtcatacatctcttcccattccttcattgtatcctctactgttaaattatctttttccataatatccaaagctttaactgctcctttagcagttgtagttattacacagttttcagatactagttctattatgttataaacttttccttcaggattaccatttgcaaaagcttcatcactatattcaactttttctgcataagactttacttcttttgcaaattctcttggatctgtttcaccatatatataagtagggaattttgttcccccttctaatcttattttaggtgcaaaagcttgatcatttttatttgcattatttactatatataccgcacttggatttatattttctggagcttttattatatttcttccaggctttaaggttacccatcttctccaatcacctttatctttaccaacttgtcccaaacataattgaggcattacaccatttatttccttctttacaatagcttaaaagtatcatatatatacttttttctttaatatttaaagtattatcagttaaaaaggatattgatactataagattattattagttttatatatattttctatcataattaaatctccataatatattttttattattatatcatattatgtattaaaataagtaatttattataaaatagtaatttatatatgtttatattataaaatttttaattaaaaattttatattttgatatattaataaatattttaaagtatattgtgttttctttttaaatttgttaaaatttaaaaaaattcatctaatcaattactaaattacaatgttttccgtaatttttaacaaaatacaaaaagtggtgtttttataattccactttttatatttaatattttaaataatagttttattaagtagtaatttaataatgtataggataccattatagtacaatagctttaaattatagtttgtactattaaattaactaaataattaaaaatttatttacttatttttaaattttttatataatataataaatttatatcttaatgaaagtcatagaaatagctctgcttagattactaagtggagctattttatttagtatgataattaaaattttaatatttataataataaatattattttcataattatttggaggaaaatatggattttaatagaattatcaatttctctacagatataggtaccctaatgcttgaaaatggtgctgaaacatatagagttgaggaaattatgagcagaatatgtttagcttatggaatagaaaaggtcgatgtttttgtaattccaacaaatataataataactataaaagttaatgaaatggcaatatcaagaactagaagaataaataatagaactattaatttagataaaatatctaaattaaataatctttcaagaaatgttgcatttaataatctttctattgaagctgctgaaaataaactaaatagtatagctaatgaaaaagagtatagtattaaaataaaaatgttaggttacttaattacatcttcggcatttactttactttttggtggaagctttaaagattcattattttctggatttataggaataattctttgtcttcttgaatactttttaaacattttaaagacaaataatttttttataaatataatatccggagctttagtatcactactagcttttattgcggtgaaatttaacattgctcctaatatgaatgaaataataataggttcattaatgccattagttcctggacttgctataacaaattcacttcgtgatataatagatggaaacttagttgcaggaagtgctaaatttattgaggcattttttatagcagtgggtattgctattggaagtgctagtatattatctatattaataaattaattggaggataaatatatggatttaataataaattcaatttatgcattttttagctctttaggttttggattattattcaatataaaaggtaaaaatttaattttttcttctttatgtggaagtttaggatggtttatttatcttttttcttctaatttcataagtaaaagtgaaaattttaattactttctagcagctatttttatatctttattttctgaagtttcagctagaatattaaaatctcctgtattggtatttttggtatgtggaataattccattagttccaggaggggggatgttttatacaatgttagaaagcttaaaaggaaatataactaaagctttagcattgggatgtaacacattaatgttggctggatcaatagctattggaatagttttagtttcatcatttaccaaacttttcttttctactaaaatatttattagtaaaattaaaacttataaaaaatagaaaataaagataatattcttaagttatcaactaaaaaagaagaaggacggagtgttaatgtattagaattatactcattatcatttggggaaaatatatgggatgaatattttaaaactaataatcgattatatacaatattattttggacattctgttggtgctgaagttggaaaaagtggagtagacggatttatatctaagattgataaactatatgagaaattttaggctgatcaagtttaaaaactttataaagtagaaatataaaagagtgttaaataaaagttaagcaatttaaagattgagaaattaagaagctatattagttaaagtttagatattaactattatgtatgaattagataataaagatgttaaaaagattataattatatttaagttggaaactatagaataaaatttatagtttaagaaatttgcatataatctgtacatatatttttacataaaccacattttatacatttctcttcatctctgcaaatagatggattatccttctcgatagctacacgaatatttgtaaataaatgtttactcatttttttacctcctattattaaaattttattagttattataagtaatatatatttataaatagtaataattaaataaaagtaataatctatatgtttaattatatattaatttttattaaatatatagtacattttattaataattaggtataattattatattcaattattaagtaaattgacaataaattttagaagatatacaataaatttaataaaatttgaattatttttgaggagatgattaaattgtgtacacacatacatatttcaagtaataaaaataatgtttattggggtagaactttagatacttcttttaatccgtttgatattggttcaaagatagtaattgttcctaaaaattttatgttaaaaactcaaagtgaaccttggaagacaaaatattcttttttaggtataagcttatcagaatcaactttattttttgatggagtaaacgaaaaaggacttgctggaggtttgctatttttaaatgcatgtacatgggacaaaaaagaaaatatagaaaaagaaggacttatagctataaatagcggagaaatagtcccatggattttaagtaattttgaaagtgttgatgatataaaagaaaatatatcaaaagttgctgttacaggagatgatatttcctcattaggagagttaggtaaagggaatcctataactgctcattatacttttacagataaaatgggaaactcagttgtattggaaccaacaaataatggtcgttttaaagttttcaataatactgtaggagtaatggcaaatgatccaacatttgattggcatatgactaacttatcaaattacattcaagttcaaggatttaataaaaatcaaaaaactttaaataaaaatacagttattacaccaatttcaaatggaacaggtatgcttggattaccaggcgattatacttcaccatcaagatttgttcgtgcaacttatttaagaaattttattggtgatattagtgatgaggaagcaccagtttgtttatttagccttctaaattctgtatgggttccaaaaggagttgaacgttttaataaggataaagatgattcagatttctcaagctatatgtgtgcatatgatcaaaatttaggtaaattatatttgcgtacttttaataaaattaacacaatggaattttctttgaaaaatggtaaagatgataaattagtaacatattcaatttaatttttttattataacaagttattttatattaaattaacaattagtttaattatatttatataaattattaaataaaaaatgtatcaataaatattgatacattttttattaattttaaacttttctttttatattatgtctatcaaataactttcatataaaaattaaataatttgaaaaatataacttattaattattattatattttttatatgtaattgtaatagtatttaattctaataattcatatatcattttatatacttatcatttattgaactaaattgtaactatatgtataaacattagtattataaaagatatacctaataatttatgaactttttttatactattatatttaaatattctagaaagtataagaaatattaaatttattaaagttaatattccaatataatagccgaatttaaaacttaaattattttttattattccaaaatataaaccaatatatccatgtaaaattattagtgaaaaagctaataatgaaagtggaatatgccattgtctaagaaaaactgcaatgtattgtaataacttacttaaaaaatttattttgaaagggtaaatatattttaatatacgtcttactataaacatagatattgaaaatataaaaatatattcgcttatttttccaatagtcttattaatattttttattgttctataagaaatattagcaaaaaagttattttttatacagtaaaaaataaaaataaatgagaatagtaaaattattagagataaaaaaatagatgttttttctaaaattttatttattggttttattttaaatgagaaaaagttttttttattcatattaagctccattatataaaataaaaattgattttatttgtatgtatttattgttattcaatagataaatttaaagtaatttatttattgctttatatttttaatgaatttattattttcattaatactttcatattatttttctttataaaagtataatttgaaattttggtaaatatatatgatatttaaatttaaatcttcttagtttttccagttgatattatataaaatgattgacatacttttatatcaaccaatatattattatttatatcttttatctttacatatgttattaaattagtaaatttaaaattttcattacttcctagaatttttaattcatcgattcttaatttaccattaataattttaagtttccataattcaaattattttctatatattttaatatttcattattatttatattccaaattaattgtttagtagtgtatctagctttttcattatttaaattatatttttttaaattgataataatctaaggatatcctaaaagtaatgctattgctattttaatttttttatctttactatattatttggtataatagtcttcattttctaaataattttttatttttgtataataagtttttagtcactatttataggggactatactactgtattataatcatagcgataagataaatgatttctatcatcatttactttaaaaaccagtccatcccttctagtatattcttggtatacttgatataatttaagttcacttgcaaaaattatatttgattttaaaattaataagatgataaaaaaatacttaaattaaaaattttttcaaattatctcctccttaatacaaaatatttatatagatttaataaatatttttgattattacaatatatttttataaatattaatgatacttataaattataagatacaactacttttataattttaatatttaaaatataatattattaagctataagtttcttacttttacctttatatataaaaacactaaaattaaagttacttatttttagtaactttaatttttctttggttttaatttaaaataaagggaaaatgattattagatagtaatagcttacatttattatactataattttattcattatattaactaaaatttaaaaaataaaatttttagacgctttatttataataaaaatagatttatttatatggagtgaataaatctattataatttgtcttttaattaaaaagaaatgataatatatagtaattcttataaatttataggaaaagtataagtttttattatatttactatactatttatttgacaattaatatgtacaaaattatttaattaggacgaaagtctttcagtgtcacaagatttaataactataattaaattattgaaaatttgagttgttttaaaatctttttgtatattttctataatcataacatattcaagtaattatactatttcacagttactttcaaaaagtttttaaatttctaaaattatatttattcttataacaggagctttcctaattttataccgtatagattgaaaattataatatttataaaaagtacatattttgttaaattagaactaaaatgcataagaaaatagattaaaataagaaatatcataaaggattataaaaatttaaagtaaatattaaattgaataaacaaaataaaaaaacaaagatatttaataatttaaaattattaaatatctttgtttttttatttaatagtatttttaatttttaatatttcttcttcacttaatccagttatttttgaaattaatgatatctctaatccttgacttaatgattctattacaatttctaatttactttctagtttaccttctttttttcctttagcttcagcattttctaaagcggatattctatcatatatagccttttctctcatgttatactgttctctttccttactatccatactaagcctgtatagttcggattttgctagtttaatttcttcattgcttagttctaattgtcttacagtattactttctggttcaactaaaaactctaaccatttttctagagcatccatttcttcaacattttcaacatactctttattacctatttcattaaacttaggtaactcaatgaaatgtatttcttgaagatctgtaagctcctcatttgaagttatttcttttagcctatatgcattatgatatttatcattttttaagtatttaaaatttaagatgtttatacaaacagttctttctaacttactgtagttatctctattttgtatttgttctgaatacatcttactccagtaatataatgtcctttgtatcatgttatattcattctttacctggatttcaatatttatatgttccttattgctagttgtagcctttacatctaatctactaaatttatcttctataaaatctttatctatatcgttatttttgatttctacatcttttatgggagttgttggttttattactgcatttaaaaagttaattaatataggtttattcttttctgtaccaaatatctttttaaatacaaaatctatttgtggatttagtaatgttctatataccatttaatttactcctttcaatagttatactctaattataatatagttttatctaaaagctctaattaaaatctattttttaaaaataattcagctttcttcagaaaaggtatgtaggttacatagtatttattctttactaaagatattatcaataataaaaatacctaaaattaaatttatataaaaaatatatattaactttcttttattaattatatattagtacttattaatatatttgaaatttctttctgagttttaaaagctttatttatataataatcacaattatatttaaactcatcccaatttaccataggaacatatccagattttatattctttgataaaattctaaaaagcttattatgagaaaaataatcataattattttttttatttggtaaaattatagctaaaattgcatttgaattaatttccataccattttttaatggttttttaagggaatataaaatttcccaaggtatccactgatctctttcacatctatataattctttcatattaggagatattaatataatagttaatgaagtattatatattttatatttaagcttttcccatatataaatataatttttatttgataaatcttcattcttttgttcacctttatatacgtaattaattctatttttaaacttattttctatccaaattacatagtctattactttaggtaaccctttactaatatcatctacataataaacatcatattctaaatgcttataagatataaatatattcattattataaacacctcatttaaatttaatttttatataattattttatatgaaaaatagttatattttccattaattacatattataaatttttcaatatattcccagtaatcttttgaataatttctttctgtaaagtttggtagaaccctgttattcgtattattcttgatatattttctataatttgaataatatgtatttctagtgttctcaatgactgtattaatataactctctaaaaatttaacagttatatttctatagttttcacttaattttgttaaaaccttattcttaatccaagagctcttaactcttgcagctttaagtaactctttaactttatttctaacatcaacaagacttgtacatttttcatacatgtctgcattaaattcttttgagttactattagaatctatatctatattattattcctaatatacctaggagtaacttgattacattctatgcttgttatatcagtcattgtaatgttttcattattgggtaatttattgggtaatggcagaaaataacagtttcttttctttacattttcaataataagtaaacctaaatcttttaatttatttactatattttttatttgttttaagcttatattttttagttctggtcttttctttttctttttatttacccaatcattataatctttatgaattttagaaaatgagatgctccaagatccattatttaataaaataccttttctgataaatcttaagatactttgagcttttcttctagactctttatattcgatttgatttaagacatgaaaatctctttcttcgagattaaagcgtttctcttgttctaactgttctttagttaataagtgtatgtgtgccataaaaataactcctttcatctaggaaagtacactaaatcctaaatagaaagaagttaaaatttgctaatattacatttctattaaaaagtcaatagatatcattgacttttttcaatagctttgatatcataaagctatgaaaagtgaatatttcaaatagaactttgttctatttcggattttagttcatccattaagtttacttactttggcgagttgggaaaacttaatggatttttccttttccgtactatttaatttaattgagttaataataccatgttaaaaataatttttcaagagagtaaaattatagaaaattttactctctttttttattaatttcaatatatgtatatactgaatatatacatatattgaaattaataaaaagcaattatatatactgagtatatataattatattttgtatatattcagtatatacaaaagtaagaaaattaaagagaataatagtattcagaagaaaaattagtataaactcagtatatacatgattaaaaagttgtttttagtatatatctagtatatactaaatttataaaagataattaattttgaaaggagcattaaaatgctaaaattgggaatagatttaggtaatggttatacaaaatttaaaggaagtaaatttgctagtaaaactaaagtaggaagattagcaagtttagctggactaggggaaaagccaaaagatatacatgaagtaggatataaaggtactacatatattgtaggagatggtgaagtattcacttcaccagatagatactttggattagattacgagatatgtttattgacagctattgggcttagtagcaaagatatagttatagatgctaatatttgtgtaggattacctataatatattttatgagtgagactaaagttttactagaaaaaaaattaaatgaacttactgaaaaagatagcataaaaataactataaatggacaagataaaattattaaaataaataatgcacgtgtttttgcagaaggagcatatgtattagactgtatggatacagataatataataactatagatttaggagcaggtacagtaaacataactcaatgggataatttaataccaatatcctatgatactataacaaagagttttaataagttatatagggatatagcaaatcatattaaaaacactggtaggggagtagttacaccagcttatattgaggctaactttggagaagatactataacaatagatggtaaagttgttgatataacagatacaaaacagatgatatctaaatatgtttcagctatagtatcaaatgtttatgatatttgtgatgttccacaagcaaataaaatacaaatatttggtggtggtgctattgcaacagaagaatattggaaagatgcttttggaaaagacagggatggagtatcagttttacctaatagtcaatatactaactcaaaaatttatcagaaagcagcagaaatattaaaataatggctagagaattaaaaccaatatcatttaatccagatactaaatcagataaggagattttagattatattgatgaacttggtgtatcatttggttcatatgtaaaattacttataagaaaagatatgagatcaggttcatcattaaaagaattaaatgataatagtgaaatagctgaacaattaaaagagttagtaagtgtccttaaaaataataatataactattaatactgatactaaaaaaatgatatatgaaacagatgaaattaaagaaagtgaaaaagaaaaaaagcaaaggctagcaatggaaaatttcatgaatatggggggcaaatagccccttatttttattttaataactatatttaaatattcaaaataatcctaaaatctttcttttattttttatgagagtgtaaaatagtctgtgtaaactactaaaatgatataattaattatcatattaaaaggagggtgcacagactatgtcttatgccgaaaaagaattaataaaacaacttgcgaaaaatcctaatataaagactgctgaagatgctcaaaatgctattaaaagtttattcggtggtttaattcaacaaatgcttgaagctgaaatggaagaatatttaggatattcaaaatatgattatacaaataaaaatactactaattctcgtaatgggaaaagtaagaaaactgttaaatctgatttagggttatttgatttagatataccaagagatcgtgagggttctttcgaaccacaaatcgtaaagaaacatcagactgatatatctaaattagaaagttcaataataggtatgtatgcgaaaggcatgtctacacgagatatagctactcaagttaatgaaatgtacggtatggatgtttcacctactttaatctcaaatataactgataaaataataccttctataaaagaatggcaatgtagaccattagaaagtatatatcccatcgtttttatggatgctattcattttaaagttaaaaaagataattctatagttaataaggctgcttatgctgctatcggtgtaaatattgaaggtaagaaagatgttttaggtatttggattggtgctgctgaatct

SEQ ID NO: 31 - DNA, 25 bp, Artificial Sequence
  Synthetic primer
gctactaatgcatcacaggcaggcg

SEQ ID NO: 32 - DNA, 21 bp, Artificial Sequence
  Synthetic primer
cccatgagcaacccaaagtcc

SEQ ID NO: 33 - DNA, 22 bp, Artificial Sequence
  Synthetic primer
tttgcatcaagggaaggcttcg

SEQ ID NO: 34 - DNA, 20 bp, Artificial Sequence
  Synthetic primer
aggaatcactaaaataagaa

SEQ ID NO: 35 - DNA, 29 bp, Artificial Sequence
  Synthetic primer
agagagctcatgccagttgtaataaatag

SEQ ID NO: 36 - DNA, 29 bp, Artificial Sequence
  Synthetic primer
agaagatctctttgtaccttttctaggaa

SEQ ID NO: 37 - DNA, 28 bp, Artificial Sequence
  Synthetic primer
agaagactcttattgtatccttcatcta

SEQ ID NO: 38 - DNA, 34 bp, Artificial Sequence
  Synthetic primer
agaggatccgcattaaatgatttatgtatcaaag

SEQ ID NO: 39 - DNA, 29 bp, Artificial Sequence
  Synthetic primer
agactgcagcagtgaactttctccccatc

SEQ ID NO: 40 - DNA, 20 bp, Artificial Sequence
  Synthetic primer
ctgtatttggtacttttgca

SEQ ID NO: 41 - DNA, 25 bp, Artificial Sequence
  Synthetic primer
cgatagagtatattatgattcaata

SEQ ID NO: 42 - DNA, 20 bp, Artificial Sequence
  Synthetic primer
ggtagcgtagtgactacaaa

SEQ ID NO: 43 - DNA, 25 bp, Artificial Sequence
  Synthetic primer
ggatgatatgtaataatgatatgtc

SEQ ID NO: 44 - DNA, 24 bp, Artificial Sequence
  Synthetic primer
ggaccctcagctgatattatacag

SEQ ID NO: 45 - DNA, 24 bp, Artificial Sequence
  Synthetic primer
tccagatgtatcttcagataggag

SEQ ID NO: 46 - DNA, 24 bp, Artificial Sequence
  Synthetic primer
attaggcataggctctaattggcc

SEQ ID NO: 47 - DNA, 24 bp, Artificial Sequence
  Synthetic primer
agcgctatttatagactcattaag

SEQ ID NO: 48 - DNA, 25 bp, Artificial Sequence
  Synthetic primer
ttagttagtctattattagtgatag

SEQ ID NO: 49 - DNA, 23 bp, Artificial Sequence
  Synthetic primer
atacatagcaatactcatattag

SEQ ID NO: 50 - DNA, 26 bp, Artificial Sequence
  Synthetic primer
ggatgatatgtaataatgaaagcaac

SEQ ID NO: 51 - DNA, 20 bp, Artificial Sequence
  Synthetic primer
cagagattgacttagcaaat

SEQ ID NO: 52 - DNA, 27 bp, Artificial Sequence
  Synthetic primer
ccgtataatccatgcagtgcatgtatc

SEQ ID NO: 53 - DNA, 24 bp, Artificial Sequence
  Synthetic primer
agcaagcacctcttatgatagccg

SEQ ID NO: 54 - DNA, 24 bp, Artificial Sequence
  Synthetic primer
cgattcttctgataatcgtgtatc

SEQ ID NO: 55 - DNA, 36 bp, Artificial Sequence
  Synthetic primer
agaggatccgcgccaccgcgactatgcattagagta

SEQ ID NO: 56 - DNA, 29 bp, Artificial Sequence
  Synthetic primer
agactgcaggttttcttgccatccatgct

SEQ ID NO: 57 - DNA, 22 bp, Artificial Sequence
  Synthetic primer
aatataggtaatgaggtacaaa

SEQ ID NO: 58 - DNA, 25 bp, Artificial Sequence
  Synthetic primer
attaaatgatttagtgactagtact

SEQ ID NO: 59 - DNA, 21 bp, Artificial Sequence
  Synthetic primer
aatggaaatttaatagatgaa

SEQ ID NO: 60 - DNA, 25 bp, Artificial Sequence
  Synthetic primer
gttggatagtatcaaattggcttac

SEQ ID NO: 61 - DNA, 23 bp, Artificial Sequence
  Synthetic primer
atagtggtaagcttagtgaagtt

SEQ ID NO: 62 - DNA, 25 bp, Artificial Sequence
  Synthetic primer
ggaatccttacccagaaactaatac

SEQ ID NO: 63 - DNA, 26 bp, Artificial Sequence
  Synthetic primer
ccaacatatcttgtatcattacaacc

SEQ ID NO: 64 - DNA, 23 bp, Artificial Sequence
  Synthetic primer
gtgatgagccagatccaagtatc

SEQ ID NO: 65 - DNA, 24 bp, Artificial Sequence
  Synthetic primer
agtgatgagccagatccaagtatc

SEQ ID NO: 66 - DNA, 25 bp, Artificial Sequence
  Synthetic primer
ggcgatctggcatacattaatgtag

SEQ ID NO: 67 - DNA, 29 bp, Artificial Sequence
  Synthetic primer
ctggtacatatgttaatgatagccattcc

SEQ ID NO: 68 - DNA, 84347 bp, Clostridium botulinum
atctattgctgtgtattttggaactactccatatgattcataagatgttccaggtccttttcttatatttacatcagaagttgtaatgtaaattgtaaaagtggaacctgttgaatatgcatatgctttatcactttgcattccaacaatccctatgaatgttaataaaaaaacaatcatacaaagtttttttaaacttcttgaaaaaattttcatgaaatccccccctaataattactcaacttcaaattaatgttaacacattttcctatttatgtcaatgccttctatttaacaaatcgtgcggaattctcccacttctaaagtggaagatggatagcatttgacattagtcaacactaaatataaaatataatcagtagtaaataataaatatgaggtaatgcaatgatattagatacaaataatcattcagtattcaaacttaattatcatttagtattggttataaaatatagaagaaaagttataaatgatgagatatcaaatagattaaaagagatatttgaatatgtatcaccaaaatataatgtaaagttagaagaatggaatcacgatgttgaccatgttcatttattattcagtggagcaccaaacacagaaatatctaaatttcttaatgcttataaaagtgcgagtagtaggcttataaaaaaagaatttccaattataaaaaaatcattatggaaagaatatttttggagtagaagctattgcttaataactacaggtggagctccgatggaagtaattagaaaatatatagaaaatcaaggagtaagaaaatgttaaaagcatataaatataggatttatcctgataaagaacaaaaactatatttatctaaaacatttggttgtacaaggtttatttataatcaaatgttggcaaacagaattgacgtttatgaaactcacaaagataatctaacttcaaaagagatgtctaagctatatctaacccctgcaaaattcaaaaaagagtttgagtttttaaaagaagtagatagtttagctttagctaacgctcaaatgaatttagataaggcttataagaatttcttccgagataaatcagtaggatttcctaaattcaaatcaaagaaaagtaattatcatagttatacaactaataatcaaaatggaactatcttcattgataatggaagaattaaaattccaaaattaaaatcaatgattaaaattaagtttcatagacaattcaatgggattataaaaaattgtactgtttctaagactccaagcaataaatactatatatcaattttagttgacactgaaaacattcaattacctaaaattgagaagaaaattggtgttgatgtaggattaaaagaatttgctatttgtagtgatggatatagagttcagaatccaaaacatcttagaaagttagagaaaagacttgctaagctacaaaaagacttatcaaggaaacaaaaaggtagcaataatagatataaagcaaggttaaaagtagctaatttacatgaaaaaatagttaatcaaagaaaagattttttacataagctctcaatgcaaattattagtgagaatcaagcaatagttattgaggatcttaaagttagtaatatgataaaaaatcataaattagctaaaataattagtgaagctagctggtatgaatttagaacaatgttagaatataaagctaattggtatggaagaaacattgtagttgcccctagtaactatgctagttctcaattatgttcttgttgtggatataaaaatatagaagtaaaaaatctagcacttagagaatggaattgtccgaactgtggtacacatcacgatagagatataaatgctagtaaaaacttagaaaaactaatagcctaaataggtataaatgaggttggaacgaccttattagcttggttaaacttgttccaatagaaatattgaccaagaagctcacgtttctataagcgagagtagttcacgaacaacaaaaaatgatttattaaaaattactgaaaaagaacgaaagctaaattcattatgcttagatttcatccttgataataatgataattttagaaaagaacaaaaggatataattatcaagtctgatatattaacattaaatgatgtattaaaagaaagcggtaactatagcacttcagaaactttttgttttattgacctaaccaatcctaataatagattggaaatctgttattatataggctcaaaaaatgaaagttggtatagtgcagaaagaataatagtttataaagaaaatgttaaagtccaaagtatatatactggacaattacaagaaaatgttaatgcttatgagattataaaaaaacatctaaatagcaatttttattgcaaaataacaacaaaaaaatttgaataacattgggataaagattaatcatagaaggtattgccccttcatttatcttaaataaaaaagagcaagtgttaatttaaaacacatgctctttttcatattcattttgtccaataaagaaacaaattttacttctattttttaatatttttatttgtatctttattttttataatatcaccaatagctgcaatatttcccaatgaagataatgtttcatttggaagtattaatttattggctggacccttggccatctcttttaatgcttctacttgttttaatgcaataacagtttcattagtccctgattctattatagaagcattaacattccttatagcatctgcttctgctttagctatttgtgatattgcctttgccttaccttcagcttctaataattgagattctcttaatccttctgctctccttatattagcttctttctctgcttctgcatttagaatagcagattcctttaacccttctgctttatatatagcagcttgtttttcaccttctgattgtagtatcatagctcttttatctctttcagcttttaattgtttttccatagatgctaagatatcacgtggtggtactattcccttaacttctacactaaacacttttataccatacgcatctgttacctcatctataataactagtaattttttatttatttcttttctaccagttgatagtatctcatctaaagtcatatttccaacaatatttctcatatttgttatagatgaatatactatccctgcttgataattttctatattatatactgctgctttgggatctaatatcttataaaaaattacattatctatagatatattaacattgtcttttgttataacactttgaggctctatatctaatatctgctgcttagtggatattctttgcctaacaaaatcaacatatggtattataatatgccatcctggttctaatgtcctatggtattttcctagtctttctacaacatatacgtaacctgtatttactatttttattgatactattattgttggcaataaaaataatataaaaattataaataaaaccttcatacaaaaaacctcctattaatcttataataattatatatacaatttttcttttttaatttttatttataaaataaaaaagaattgggatttgttagattccaattcttaaaggtttttttataatttaaaattagttgtattgcgaattaatgcaatattattgattgtattataatattctttttcactattaaagctttccatagcagatacttctgatatatcagctcttattgtatatccacatataggacatacttttaaaaatattatcttattgtttcttttattttccttagttctagtaaacattttttctccacaatgtttacaaaaatctctatttttcatttctttttttcccccttaaatcttagcaaatggccatacatatatatgtatatatttattattcttaattttgaaatctaatgcataagagcattaaatttttgttttttatattcttttactatttttggctccttttctatgtatttatatacagaaaaacttggattattggattaatagtatttctgtaattttctctttccaaatttatatttattttctcctccaaaaaaggtatattacattctttgtaatacgccatgaataatttttctctatttaaaaaagagaacttaggttttatttctaaaacacatcctaggtattttgtttgttgattttttataaatgaatatttttctgttacatttccattttctacacaatataaattaagaactacattatacaaacatcctttatgttctaatttttgctttaaatgaaaatattgttttatgtcttcttttgttaaataaaacaatacataagcatttcctatgtattttccttttctatttttatgtgaagaacaactagccaccgttggaaaatagttattaatataattaaccaatggttctataggtggatccagtttcaaatagtcttctgtatatagactattttttttattaaccatgtttactaactccatatttatcatttaaaattccccctaatttttagctatatttagccataatttatactctaattaattattattactttttaaaatgttatattgtataaataaaagaattaacctattatatagataaaatcccctttaatttttataaaatatagaaaaagaaaaggtagcaagactttaagcacatagtcttcctacctttttcttttaactatattaataatattatttaataaaagcttaatttttttattatctattaaatataatgttttaaaatctgaaaaaatgtatatttttataacatgtcctttatcatttaaaattttaaaaccataaattacttattttttattgtacaatctaataaaaaaatttattataccagcataaatatatgaaaggagtaagttgagacctattgtatttttctcaacagtgataggcatgttatcttattacgaattattattagaaattaaattaagtaaggatatacattttagtaaatcttatgagatattatctaaattttttaatagagtaatgttgacagataattatcttaaaacattacatgaaaggaaaggtgtaaaattatattctttttctggactgtatccagcagccacaaatcaaatttataaaagaaatgccctatataaaattagaattagaagttttgatccagaatttatttgtgctatgcaattctcattaagccaaatacaagacaatgatataaatataatatctattaaatttataaaaaaccagcaacaatttattgctgagttagtatcaataaatcctgttattttttcaatttgggaaaagcagaactactggcaaataggtgacaatattgacttgttagggaaacaattgactaacaatttattacataaatataatattatatcttgtaataaacttacaacacaagatacaatatttcactgtttaagcataactaataataagactatttatattccctataaaaaaggattattgttaggtaataaattaaaaatccaagtcaaagaagatgatatatctcaaacacttgctactgtagcactcggagcaggtattggtgaaaagaatagcattggcatgggattttgttatggccattaaccattaagaagaggggtgagatttaattggttattgatatgatgtacaattttaaagatttatatgataaaaatggtgacaatttaatagtagataattatcctttaaaacaaggtgtttacattatcgttaatgataaaggcattaaagattttatggttataaaagataaagaagcaatatcaaaagataaagaagaattatttaagtatctaagacacagagattatctaagcatattgaaacaatatgatactaacaaagcagtatcaggtagagcgaaatctattcatagcaataattttttatcattatttattagagaaaataaatcttcacatattttaaaagattcatcattaaatccttcgttagaacaacaagttggatggtattttgatcaatttaaaaagtggcaagaagaagaaagacaggcccataataacaatgatccaagtaatccacaagaatttatattaacaaccttagaagattttgatgaacaattattcaataaaagtaaaaaggctatattaaaagttctatcaaatttgccagaacttttaagtgaatatactttggcagataaagattatattagaattttttatgaaatgccaattgaatattataacaaagaatataagaggtacatgataagaaaaatatttaataaaaatgtatatcatatatttaaagataataatgtgtatggtatttctgatatagatcttaccactaataacaacaaaccatctttattgttatacagtatgaagactagagtatctctgcgtttagactttgataccttgctaatagctcaaaaactatttgactttctctatttttataaggttcctagatataataaagaatctaaagcagtggaatatgttaatagtatttataagaccttgtatattccaatggatttcaatatagataatctagatctaaacaaatatactaatacagaccagcctgtttattacattactactggtaatggacaaagttttaatgtaataaactatgatattatttacccatttgattcaaatattgattttagctttaatgattatttatcttcagatgaagatgtttatgaaaataatgaagatagtatagatgatacatcaaatattagcaatataaagactcttttagatttagaaagaattgttgataagtatttttttaactttaacttagtaagtaactatcatagtgataaatttattaataataaaaaatatactttacccaataacataagctgcatgctgttttcttcaaaacatttatttcatgattggtttaggaagggtatagatatagatattattgatcctataactaatgtaatggataatttaatatcattatgggcaaatgatcctgatattagtcttattaaaataaaaaatatgctgaatttaagatggtccatacttgattatttatatgagagagaggggtatgctccaatggaggtaaaagagcactttgaagctatacgttataatttaaaagaaaaaatacatgataagtctcttgaagaaaaatacattaataatactgaagaattttattatgcttgtggtcaattaatctattatttattaacccaaaataaaaaaacattaaaaaaacaacaagctacaagtaaatttctacaatgcagaaatagctcaacattaaagatagagatattaaaactttatgaagaagtagcaaataatatatctgcttataattacagatttaataatttatattctatggtatctacttataacgatagcaataatacaaaggactatatagattatttattaggtgggctttatcaaaaaagcattatttatgaaaaaaagaaacagtaaaatataacgattgcacaactattatctaagttgaaaggggatattaactatgaataaaaaagtatatggcttattaggtgtaacagcagtaaggagtaattataacgcagatttttctagtcatccaagaacaagtgctacaggtgaatttatagccactgataagactttcaaatatgcatgcagaaaatattggacattagataaagaaaaagtattggctttctcaaatttgaatgataatttaaatccaatgacattacaagaaaaatatgagtatttattcaatactaccatagacaagaaaacaacaaaacctatagatgttttatctaatttattttcttgtttagatgtcttaaattttggggctacatttgctatatctaaattaaactttagtattaatggggctgttcaaatacaacaaggcaaaaatgtatatgagtatgctaaagcagaaaaattatctcttctaacaccttatagaaatcctaaagataaggatgatggctcagaaaagggaagaactactactgctgaacaacatattttagatagagcagaattcatctatccgttttctatcaatccagaaaattataatgaatatataggcttagtgcctaactttaatggatatacagaagatgcatacattaaatttaaagaagcagctagggtaggggtaacatctttaaatacttgctcaaaagctggctgtgaaaacaattttgcattatttatagaattaaaggattcatcaaaagcatacttacctaatttatcttcttacttaaaatatgattttgattcaattaacacatttgatcttactaatattactgaactattagaagaaattaaagaagaggtggaaaaagtagaagtatattacaataaatacttatcagatatagttatcccaagtactgatataaaagtagaaagaagaaatattctaactggcaaagaaatgatatagtttttaataatttaaatcagagaggagagaaggcaatttcgacctactttattgattataaaagtaggcgtatacttgccgattttaaatggaagcaattaaattcaatttatcaggtcctacagctttttttaagaaacctgatgttaatagttatgcctactttacttataataatattcataagattgccttattaggtatactaggttccatcataggactcaaaggctataatcagcaaaaatctattgatccatatcctgaattttatgataagttaaaaactttaaaaattagcatagtgccaaagagtaaaacaggatatttcactaaaaaatttcaaacttttactaacaatacaggattttataatatagatattaataaaaaaccatgtacattagtttatagggaacaatggttagaaaacgtaagctgggatatctatatattactagatgaaaatagtgttgataaaaaaattctagataaattaaaagattatttgttaaataaaaaatgtcactttattccttaccttggcaaaaatgatcatactgctgatatcacaaatgttgaacttattaacttaaaatcaatacaagcacatgaaaaattaataagaatacaaagtttatttttaacggataattttaatattacaggagaaaaacatagtcctaatgagagattaataatattaaaagaaatgttgccaactgaattagatgaattcgataactcttacaggtttagcaatttatcttttactaatctcattgttcaaccaaatactagtaaaacattaatttatcaggattcactaagtaatttatatttcttttagaaatttaaaagtcatataatgaaagcatgttataataattatataaacattttattatttacaaatggcttattttcattggtttaacttctacattagatgtatttaaatgtaaagaacagaaaaaggtaattaaagaattaaatgtttaacttctacattagatgtatttaaactaaataaggaacctcctaattttttattgttattaaagtttaacttatatattagatgtatttaaaattccgttttttaaaataggaaatttttaataaaaaagacttttaacttctacattaaatgtatttaaacacgcatatttgaaatatggaaaatggagtaaattgggtttaacttatatattagatatatttaaactaccgatttatagtaaatatattaccaatataaaatagatgatttgtttaacttgtacattacatgtatttaaaccataactactattataaagttagctacaacactgaatttaacttatacattatatgtatttaaacagagaacaattgcaaaaaaagagaagagttttggatggtttaacttctacattagatgtatttaaacaaaatcggaggctttttaataatatttttaataagtttaactgctacattagatgtatttaaacgaaacattaaatttataatctgaaaaggggaagtttaacttttacattacatgtatttaaacgtgttaatagtaacaataaaaacaaataaagtttaacttctatattatatgtatttaaactaccgaaaaacacaaaaaagatataagaatttttcctatatgtttaacttttacattagatgtatttaaacaattaatttgttctctcatttgtaaatatacatatatttaacttctacattatatgtatttaaactggaaatagtacgatttatttttaatggattaataagtttaacttctacattagatgtatttaaagcattgaaagcataaaaaataaactagaaaaatataagtttaacttgtacattagatgtatttagatatgcgtagacttaacagttactttgttttaactttcgttcaacttctacattagatgtatttaaacaaatatcgctcaacaacttattcaacaattttagcggtttaacttttacattaggtgtatttaaaaaatataagtttaaatataaggagagaaagagaaggtgcaaaaatgaagaaaaaaagcatagatagagcttgctatgttagcattttacctgatttatatataaatgaaccatcggatggattaatcttaatagataaaatttcaaaaacatattatgaactagcaactgatactccttgtgatagaagtgatttaacatgcttaaatactgattatcaaaacggtaacttagatatgcttatggagattaaagaaaatttatcctttactcatatagctagagattcacatggatttatttttgcagtagaaatagtagatttataaaaaaataatatatttaacttttacattgaatgtatttaaatatcatgccagatcataacttattacaaaatttcaatttaacttctacattagatgtatttaagctagtatcatcctgcatgttttataatttttcttagtttaacctttacattagatgtatttaaactaagctccacaaacgtttattgtcctaatttttattagtttaacttctatattagatatatttaaactagcaaggaacctcctaattttttattgttaataaagcttaacttttacattaaatatatttaaacggtgtgtgtaaaaaacagaaaaaataactagtttaacttctgcattggatgtatttaaacccttctttttttcttttatataggagctaattagtgtttaacttgtatattagatgtatttaaactttaatttacaagctgttacaattcctattagcaagtttaacttttacattagatgtatttaaaccttaatgaggaggttgtttaatgaataaaaaaataaatttaacttctacattagatgtatttaaactaaaaatggacgattttctttaaacgaaataataaagtttaacttctatattagatgtatttaaacttataaagacaaaaagattttcatttatcttaatgtttaacttctacattagatgtatttaaaccaaaaacctcctatttgtatagcatagatttaacttttacattgaatgtatttaaaggggacagagagatatataaaatttagttatataagtttaactgctacattagatgtatttaaacaatatacagcaggaaatactagaaaaaatagtaaggtttaacttctacatcagatgtatttaaacgttgtaaaatatgtaggtggagctaaggagtgtaagtttaacttctacattagatgtatttaaagtaccgtttttagaaaaaagattgtttcatttacacatatgatgtataaaaaagcaaatagctattaatagctatttgctttttctatattactttcaataaatcttctaaattaaattctatttttgcagctaatttcatagctatcctttctaacataagaatttcttctggagataaataagataacaaactacctctgaatgttttcattttagtctttatatcaataaataatagtatcttttctattatacttttagcttctgatatattcttttaatatattagtaataaattcagtttttgttttataaaattccgctacttctgctatagttgatagacctattatatccaccttcttaggtaatactgataattctcctatagtattaaataaacttatatcattagctaacttatctcttagctctatattatttaacaactcattctgcatatcaattgctcctttatatgttttttatattttatatatacaaatataaaaaaattataaaaattttagcctataccttaaattattataagatataggcttcttcatataatcttttccttattttcccttgcactgattgataattgattctatttcttcataatcaatttctccatctccatcaactatacattcagctctaatccattctgctatattctttagcatcctttttgctgcattattttctcttatacttaattcttccctatctgttaatgcatttaaacactcctctaaatcctctacagtgttttggaaacgacaataactcatattactcattatataaaattcccctttcttttagctcttaaaaagccataatccattatttaattaattattaatacttttttctatctttttactgcataagataataaacttactatatgaatataaatattttaaatatactttaaaatattgctttatatatttattagtttaaattgtttggtttacattttattaatttacataatatttaatatgtatctatatagttgtattatttttatataactaatttagatgtataatctcttacaaatcatgtatgtttttttatttttgtaataataattttatataaaaacgatgtaacaaataacaattattgaaaggagaaatcttcattgtgaaaaattatcttaaaaattatgttaatcatgtaatatttatatgtattgcagtagaaatactctctttaataattttggtttcaagaaaatgttccattgaaaatattatattgttatatatcttgccatttatattagtattatttattaccattctaaataattttaaggatagtaataaatctaatattgatgataaatatgaattaattgataccttggatttataccattcaaaaaatcaatttattcaaaaaaaagaaattaataatgagattatatactgtttttcatacatcgatagagaacaaaacatttctacagaaatcataaaagagaatactgaaaatcatgttatagtaaagaaaataaatcattataaagcctatgttgaaatttataagaacatatatgataaaaaaaatgtatacattatttatttaccaaagcgtcttgcacttacgtagaaaaactctccatatataatttgaattatatatggagagtttttctattaaacttattgttttttactgcaacacaagtcatttttaaatttgcactctgttagagcagtatatataggtgaagtattccagaatcctttatcagtagcggtttttctgttatatactgtttcacaatcatatatatacatgatgtcagaccatttagcattttccatttttctttctactttctttttattttttgtccaaaggatataatgtgaactaccaccacttatagaagatggtggcttcgtggtcaatatatctaacgatacaagttcacccacgctatcaagattattccaacctctctagtcaatatatcttttattatattgctagttttaataagtttttactcgcatttaagtccctatccattatcattccacatacaggacaaatataagttctacaagacaaatcttttgtttgatttgacttattaccacaactagaacataattgactactagcatagtttggtggtgcaactattatctttctgtcataccaatcagccttatattctagcattcttctaaattcataccatgatatttctgatattgcttttgctaatctatgattttttaacatattactaactttaagatcctcaataactattgcttgattctcgctaataatttgcattgagagcttatgtaaaaaatcttttctttgattaactattttttcatgtaaattagctacttttaaccttgctttttttctgttattgctccctttttgtttccttgataaattcttttgtaactttttaagtcttttttctgatttccttagccacttaggatttccgaaaaattctccatcacttgttatagcaaattcttttaatcccacatcaataccaactttcttatctgttttaggtaactgaatattttcagtatcaactaaaatagatatataatatttaccacttggtatttgtgaaatagtacaagatttaaccaatccattgaattgtctatgttgttttattttaatcatagtttttaatttcggtattttaattttgctattttcaatatatatagtacctttttgattatttgttgtataactatgataattactcttcttacttttgaatttaggaaatccaatagatttatctctaaaaaaatttttataagccttatctaaatttaattgagcattggctaatgctaaactatcaacttcttttagccactcaaactcctttttatattgtgcaggtgtaggatatttactttgcttaatatctaaatctttgttttcttcgtaagacttaatcctgtccgctaacatcttattatatataaatctagtgcatccaaaagtttttgcaaaatatagcttttgttctttacttggataaatcctatatttatatgcttttaacattcacttccctccttgattctatatatatttcttttattgactaaattcaagagctattcgtctcccacctaataggataggagaattacgcccgttaagttaaattcttttaatgtcatttctgattttaagcaatcattattacaaaaatactgcattccaccatctatacaatatccttctgtcataagctttccacaattagaacatattctcacttccatttcctgatgctctaataattcttttaacttttctttatccaaaattatattagccaatcttataaatttctttgttgtattggtattcattatttttcttccttcctcctaatcttagcttttatacgccatagctcattatttaattaattattattactttaaaaaaatttattataatttactcttgtaatattttaaggtatatattggtataatatataaagagttataaattttgtaatttataactcttccttaaattttagcttaaagccaaaagaaagagtattaattcaatactctttcttttttccattatatattgtccttatgtttaaatgaaggcaaatttaaaatcatttttaatatttattaagttgtcattatctatattattaattcctttactctcattgataacagctatagctgtatttagtgtagctataatatctatttttttaatgatatctatttctttattacttataatatcttttttaaaattatttatattattataatccatttctattagatgctttgtaatttgtttatttaagttcatatatataacctactttctcttgttttatacttaattattattactttttaaaaatttagttatattaataaaaattttatttaaaaattttaaataagatttttttaatcgctacattgaagtactgtttccacttctaaagcctatatctactttatgtaaatgcaactaaaaatttaattctatatagtggttgtcaattaattagtgtctaatacgataagaaataatataaaatttttatgtgaaaataggaaaatactactatttacttaacctgaaaaaattaattgcttgaaaatagatatattctttaagtaagatatggtataatatggttgaaattttatgcttattaataacttgcaaaaggatgagaaattaaatttattgaataatagtattttatataaatgaaaaatagacttttaaatatgtttgaaatagtagaaaaataaattatggattatagtaaaactataaagaaatattattatatataattaaatataaataattaaagattatacgagtaaattgagtataatagtaaaagtaagcattaaagcaagttataaatgtttatgaaagtatgggctatgataaatcttatttttactctaagcatgaaaatataagaaaaaaattatttagaactatataatgattctcgaattattaacaaataaaatagttatttaaataaaaactatagcaatttaataaaaattattatatattttatttaaaattttaatttataaaggtgatgtgtatgtttaaatatatagataaaaaaaaggaaatacttgatagtaaaagaccatttaataaaaattctattgaaaatttaaagaaatattttgatgtagaattgacatataactcaaatgctatcgaaggtaacactcttacaattacagaaactaaaattatcttagaggatggtatcactattggaaaaggaaagactcttaaggagcatcttgaagttattaatcataaggaagctattgattacattaaagatatagtaaataaaaatattgatattaatgaaaatgttataaaggatttacactatattattcttaaaagtataaacaatgaaaatgcaggtagatatagaagtgttaatgtgcttataagtggtagtaatcatagaccaccagagcattttttagtttcacaaaatatggaagaattgattaaatggtataatgaaaataaagataatttacatccggtaagacttgcagcagaatttcatcataaatttacttttatacatcctttcatagatggaaatggaagatgtggaagacttcttatgaatttaattcttatgagatttggatatccaatgactgttataaaaatacaagatagaagtgaatatatgagtgctcttgaaaaagcaagtgttgagaatgatttaacagattttataaacattattgctgaagctgtaagtagcagtttagatacatatttatatatattaggataggttaacaatatagttaagcagctttattaatgtgcaaaattctcccatcttctaaagtaggagatgggggaattctgcgcaaataagttaaaaaggtatatctccatcatctactgaaattatatcgtcatcaaaattgttcccatttccaaatccttcgtctgattggtaacttgattctgatccattattatatgatgaatctgtggtagccttatctccccactcaagaaatttaacttcttcagctattacttctgttatatatctttttgtaccatctttagcttcatagcttcttgtttgtattctaccactaacccccataagttttcctttgctcatatagttagctgtagattctgcttgctttccccatactactataggaatgaaatctgcttctctctggccatcctttgaaaatcttctatctacagccaaagtgaaattagcaaccgctgttccattccctggagtaaattttaattcaggatctttggttagtctacctattaaaacaactttattcatttttaattacctccgtaaattatatatattatagttgtaatctttttaagaatactttacaatgtcaattactcaccgcctatagaggcgggagcttgtaactctactacacatggtgttaatgatacaaagtatctcccatctcaaacgtaggttacgatacggtgattgacaacaccgcaacatagtgagtttactcactatgttctttggagaattgttcaatatattcaagaccttttctccaaagatttattgatccaattctatcatcattagattgatagttgcaatttttacatttaaagatatgttttttcttatctctattagctttttcaatatgtccacatttggggcatgtttggcttgtatatttaggattaactgaaataactattgagttattcattttagccttatattcaagcagctgcctaaattgatagaaagtccaagatacagaaacatatctattgtttatatttactttttcagtagtatttctaacgttagttaaatcttcaagaacaaataacgtgtttgccccatatttatcaacgagtgcctttgtaatggtatgattaatatcattaacataacggttttctcttgaaccaatagatttaattttacgtcttgctgacttgctaccgcactgttgaagttgttttcttaatattttataatgacctcttttagcttttatatgtctaccattgtagaacgtggttttaccataactatcatagatagttgctaaaaaattaataccgaggtcaatacctactattttattaatttcaaaaggtgtagtttgagggtaatctttggtcattggaatatataagaagtatttgttaaacttaaatactaatttagcagtaccaaaactataagaaccatcaaaatatttttccatgcctttagtttcgtaaggtatcttaagtctaccttgtaaactatttatagagaatatatcacttttaatagagtaatctctattccatacaatgtcatattctaaatttttaaaatgcactaaagtaaaatcatgtccattggacttattggttttatatttagcaatagtagtttttatacaactttgagccatttgagattttaaaccatatgtttctcttaaataataataagtatcttcattaatctttttctgattaagacaattattattaaaaatatatttagatatataattcaatgcttttctaatttggaacattgtattatttaaaatatctatttgctcattagtaggatatatttgtattttagatgttatagtaatttctataatatcaactcctttcactattataattattatattagtgaataaactacaataagaaagtgaggtgtaaagtggcaagctgtggtgttacctatcagcaagtggcaattcctcccccacttatagaagatgggagtacccttgccacgattgaatgaaaattatggccatttaaattagggcataattctttttatatttgtgtaatcccctaatggtgaaatctttactacatctcctgtgtgtggagcatgtatataatacccatttcccatatatatacctacatgagtagctggatatccatgaaaaaatactaaatctcctgcttttgcttgagataatggaacatctatgcctacttgttgttgttcctgagatatcctaggtaatgaaataccatgtgcattataacaatataaaactaaacctgagcaatcaaagccttgtggagtagtacctccccaaacatatggtacccctaaaaatttagttgctaaattaactacagaattacctatatcatttttactattaagtacaggtccagtttttaaaaaatcattatattcagcatgattttgttgagctattatactatttgtattgcttgcattattaattttagctttatttaattcttctagcttaacctttagttcctttttcttatcatctatagttttaatatcattctttatagaagaagtattcttttctatctcctttttattttttgacagttttccattagtttttattatatcttgtttatccttttctaatgttttaatagtcgtatttccctcttctaatactattttcattattttggctttatttaagaaatcactcatgttttcagaagacaataacaaaactaaagcattgttagaattattatcattttctatataataatctctcatttgagcattcaacatattttctgtttcttttatctcttcttttttattctgtataaatttttcattttgtttaatttcattaattaatttagagtttttgtctttattatcatttaatttgatagttaaattagataaatcattatccaatttctgtatctcaattgttaaatctttctctgttggagctgcattaacaattggatgataaaatcctataatgcttccccctatgatagcactacataatattatttttaatttattctttatcataaagatatctactcctatctatatatttaaattgtattttttagaatttaaattataatcaaaataagaggtgattataattggaagaaatatttaaaattaattatttgttaccatgcgattctagtagttcagaaggatactctaaaagtactactgtagaaaatgcaactgacaaattaaagctatatttatcaaataaatataatattgactttgcagatatagctattttatcctgcactccaatagaaataattcaataatacagatgagtaaaatccatctgtattatttcaatctctttatgtcagcttcggcctcttcaatttctaataccaatttcataaattctatattttcttttaactctggggtattgcttgaacatattataaaattttccaagcttgtgcttatattataattaaccaccattagatcattatcattaattcttaaatcatttaaattatcttttaaatggttaagttcactttgaattactttattatcatatattgttgattcagcaatacttatcaaaatagggattatagcattccttttttgatatatattctccagttgtttttgctttttacatttgtggttctctaaatattgcaacaatgtatggattatataaagtgaaaatattatcattaataatactgaatacataaaatcgtcctttctctagtatcataagtgacaatataataattttttataattattaccttgaatagtatattgataaggatattgtcttactcttttattagcatattttttaaagaattttttcgtctttgactttgatttttggtttttgataatcataatttatacctccaatgacattctttatataattatttatccattttaaaagttttggcttttataattctaggaggtaaaattattatttatattacgtgaaatacccttgctataatggctataatacaagataaaaaataatatataacaaaaggacattctttatttttacgtttaaatatataaggatctaaaaccgatagtaaaagacctattaaaagacctatatagctataaggatatataaacaaagtaatagcaggagctaatttaatatctcctccccctattcctatttcatcagtcattaatccatatactaattgcaagatatacataatagcaaataaccatattgaattaatcaatatatactttattggtatttttaataatattgctattaagaaagctaaaatatactctattaaacaggtcctatttaatacaattctttcttttatatctctaatagatgccttatataagataatcaaataaatattagtcaatataaataatataatattttttataaccatattttcctctcatctcccttcaatctttacatatacaaaaaattaaattataaaaacacttttgtttaatttttttaattattgtatatataaaaagctgtaacttataaattaaagggggagcataaaggatgatcagtccaactataacaaaccaattcaataataatattgaaatatgtaaaacactaaagatactacaaacaataaaagaaaaagatataaatacttataatcacagtgttaatgtagcaaagcttacatatgattattgtgtatattatgatttagataataaaggtaatatttttttatcagcattgttgcacgataccggtaagatttttatagatcctgttatactaaataaaccagggaaattaacaaacatggaattttctaaaatacagcagcatccaattctaggatatgaatttctaaaacaacataatatgggtgaatacatatcgcaagctgcattattgcatcacatatatgaagacaataaaggaggttatcctaaatttaatatagcaaaaccagattatatacgtttaattagcatatgtgattcttttgaggtaatgacttgtaataataggctttatcaaaatagcattaacacatcaaaagctttagaagaaatagaaaataatatagggattcaatttaataatagaatcgcagataagtttatatattggatcaaagatacacagtaacattactttaaattattttgtgctaccctttctacctaagggagtgatcctttcatacatttcttataatataaaaagagcaacagcacttatgactttaatcatgagtgttgttgcccttttacctttattggatattaattttttgtattttcatattattttcttttaatattttaataaagcctgcatttacagccttaattccattaattaatatttttctgtcattatcatttaatggtattatattaatagtaccattatcgtaagatatttgtgaagatcgtaatccatttcctatatctataatataatcctttggagatttcaataatgcattaataacatattgctttgattgttcaaatatattattaatatcattggcattgttcatatctgaacaattattagctgctactggattagtattagtagatttgagaactttttttataatatcactaattttttcttcttctgttttatatttcactaattctattaccgctacttctaataaagttaagttattagaagtatatttactatcattaattttttcttgtaatagctcaatatacttaattaagttttctttatgaacttgttttcctaagttaatcataacctgtttttcctcttctatagttgctatttcagtattagggtttatagctaatactaaaacatttctaaaatatttctgcagatctttcattaattgatttgcatcttttttattttcatttacagctttatttataagctgtaatgcagatatagtatctttcttaataatgctaaaagctatatttcttatatcttcttctatcattattcctagtaatgtagtaacattactataagtaatctcttccatagttctaacctgatctaaaatacttatagcatctctcatagctccatcagctactatagaaatcaactttaagcttttattatctatttttatcttttcatgttcacaaatatatttcaacctattaaatatatctgtaacatctattcttttaaaatcaaatctttgacatctagataatacagtaataggcaacttctgtggatcagtagttgctaatataaatattacattcttaggcggttcttctaatacttttaaaaatgcgtttacagcacttatagacagcatatgaacttcatcgattataaatactctatatttacattctgatggagcatattgggcctgttctataatattccttatatcttctatcccattatgcgaagcagcatctaactctacaatatctatacaattacctgcatctattttttttgataattcattatctaatggttctccattatcatgctgatttacagcttttgagaaaattctagcggttgttgttttaccactccctctgtttccacaaaataaataagcatgacctatatgtccagttcttatttgatttaataaaattttggtattttctccttgacctactacatccttaaaaaatcttggtctgtactttaaatataacatcttgaaattcctccctaattttagctctacattaagccatatattctatttaaataattattatttcaaaattttaaaataccttaacagcacttagtactgttaaggtattttttcttagatataggtataatgtcttctttattgcaacgcaattgttttgatagcatatctatatataataactttataacttcataatttgaatatataacatttttatattccattttaatatatattgttttatttaaagaaggcaaattatgaattttaaagtaaaaattgttcaataatgtcaactcctctaagcaactgttattgtaattgaactattattttttatttcttctttgcaattatcacaaacaataattccatcaattacattattattttttatttctatttttttattgcaaatgacgcatatattatttttacctttcaaaattaattcaccttcctgctttctttaatattttcattattaactgctcctaattacagaacagcttaaaacttaattcttctaatactatattaggattagaagaaaacttaattctggtttcatttcccataaatgcaattagacttttgtctaactcttcttttgtaaaattattagatgattcataaattagtttacaataataaggattcttacctgtaaacttaacaaaactatctaagctatggttgtttacttgaaacaatctagcttcttgtaacatttttatatgatttaacaatgtataaaatacactaacaggtttttcacctttatctaataagttcttaagtgtattaaagtaaccattgatatctttcttactaatagaatctgttaaatcaaaaatatcatcatcattataagaagatatacagtttattatatcttctatatctaatgtatttttatttaaacataatagcttctttatttcttgcaaagctatatctatatttaaagttttattaacaaatagatctaacgcttcatttgtaatagtagtattgtgcctagcaaaaatactattgcaaactttttttacataatcagattgaaactccccatttataataaagaaatcatttttaataaatttctttatttctgagtttttattaatatttgttcttttatcttttatatatgaatataaaaaaacattagtttcatctggaatactcttcaaagcttttaacaagccatttattttttttgctactcctgttttgaataaaggaagttccattgagataactctcttactatccataaatgggattgtatttattatttttttaaactcattttcctcttcaatcattttaaaatccattttattaatatttaattgtggatttataatttgtgaacatagtagttttttagttttattaaaagctgttacattatcagtaataagtaaaatcttattactgtttattgttttaatatttgttatattttccattttatttcccccaataatttataaactttctactaattttatataacgattttttaaaatttcatttcttgctataacatctaaatagttattacagcccttactttcttttaatttatataaatcaatattttccttctcagctagctgcttataaactttttgtcttaaggagctatagctaatattatatttttgagccattttacttattttctcattagtaatttctctccataattcttttttatatgaatcatgagtctttttattttcccatttttttgatagtatggtactaatattaaattagcatcttttacacttagccctaatttttttgatataaatataaatccttttgctgaaattaacacgtcatcttcttctaatttatcaccattcggtaggtccttaatatagttatcaattattagatagctatttacagggccttcttttattaaagatactacttctctatgatctaattgtatattgcaatgtttttttaacaacttagttattcctatcccattaatatacttttgttcatttctttttaaacatataatcattgtaactcctccttttattcttttagcttcaagccataataaagcttctttaaaattattattccaaaataaaaaaagttgcggttattccaataaccacaactttatatatacttttttattaaaatttattaacttattttctctatataatttcttctacattattaaaatctttattcgctaacaatctataatttttaaagaatcctcctaaattatttcttatcagcttttcattttcttcccaggtatatcccaagggagataataagcattcatttcctaagaataaatcagcttcataattagaagccagttgatatgctgttagcacatcactcttaaatttaaatggtttctcatatgctttaattaatgtaaagacatatttttctttaaaagatttatgcattattctatctaataaagtattaatacctttttttattccatacttatatatatttttgcatttaatattgatatattttagtagcggcatttcccattgtatatcaacatttttaagactatctaaatagccttttttgttataacttataattaatttgcctaagtaaatatttataacattagactcgcagctcaattctttttcccatttacataaacctaatcctgatattgaaaattgtagtccttcatattgtcctataaataatagaatcttttttcctatcactatttcctttacttccattccaaaatctttccactttaatattttcatatagcatcctcctagttttagcttttaaaagccataatttataatctaataaattattattactttatatttttttatttgatttatataatatagagctcgtaacaaaaaagagcactgatttcttaactatcagtaccctttctattaaataaccgtatcatctttttaatatcatttatgaaaatttcatttttccttctcttaatgttattggatttaatgtaattatagttttattttgctttttagcatattgtatacaattataagttccacccttacattttccattatatatagctataacataattagagcaatcaaccatatatctattccttacttgcaattttcttatattataggtgtctttctctattttgggtattttatatctatctagagcatccacataaactaattcatctgctaagttaagcattcttctgtatctttctctatctatatcgttccatttattaggttgatttttaaaaggtatcgctattatattctttatatatggataacggatcttcaaattttctactacaaaaaatgaaactgtatctcctccaagagctccccctgtaataaatgtatctatactatatctttctattagcataatacatatttctctaatctttttagctaataattgatacttcttattccttagctcataaccatataataaatgaggcctatgagctgtaaaacatactatcattatcacaaagccatcctttctttttataaaaaatgctaagttaattaacttagcatttacttatgtttatacttttatatctttggaaattcctccatacgttatttattttgtcttaaaaaacatatttatttcatttttttcttcttattgctaaaatatggtcagtcattcctattacagaagcttccaatgttatagtactgctaatcacttgagatgatttagaaactttagctaagagtattactgatactacaaaaataaatgaccaacacaaaatcattgcaatatgtttattaaatttcaaagacatattataccttctctcttaattttaatataaacgcatattaaagttctttctatttaaactactataaatactatctaattatttacactatatttcttgaattttgtatcttaattaaaaatactttttaattcatctatgctttttgtagaaaatatagatataacctcatactgccaatcatattgaggcttttcattatttgctattgtgtaatctaacatgatttcatgtacttgattccacctcatactcattaattctggtgcggtaagactaatactatttttaatgtttaataattcattattaaaatccttattttctgatacactaatcatttcttctataacattttctaattttctcattctttattcctcctaatcggttaataaaaactacattttaagtacaatattatttgtattgcgactatgaattcaatcttgagacgtatttttagagtggaattctttctgtaatttaagtacttgcattgtcattctaatacctagcaaggtgaatgatattagtgttggtataccaaatatcatcgcatctattgttccaatagtgttaatcacttgcgtagcaccaacagcaaaagcaattgctaatccaatatcaaggaaatatagtagcaattcttttatttctttttccataatgtgttaccaccttttctcaaatttctcatttggtctttggaatgtgaattaatcataatctttatcatattcagctataatatcaaaatctttattgcagttttgtgaaatatagcatgactcatgtgttgtaaatacaataagtccattataaatatcttttaattctctatttgataattcaactttcatctttacctctccaatcttttaattggcactatctacaatatttgtattgtgcctattcttcatcttcttctaattcccctgttagtagaacccttttacctttgtaatcttcttttatgcttactctataaagatttccatagaatctaccaatgtttgtaccttcacttcctgttgaaacctctatagataaagttttatcttctattttttccaatttttttatcaattcttttattgtcatatgataaatctcctttacaagtctttgaattgcgacattgaactacttaaaatttatctttacttatttaaaagatactctttaccatctttctgtataaactctttcctttcaaatacatcttctttttcaactactataccatcataattaatccatactgcttcaaaagttaaagtattatcatcatttaatatttttaatacttcccatatttctaataattctttctccatatttaataccttactttgtttcttatttttttttgaactgttagttcacaatattgtgaactagtcatccaattgccctccattccattgtttcataatgatttcatttctgtatataatttttaaattgcttcatattcccctttagtcaattttaatcctccgcaacaatctataattacatggtcattataaactttttctgtattccatgtggatcctatcagtgttcttataatctcatcttttttagttgtttctgtttctaaaattcttattttcatagtatcctcctaactttattacacattatattaatttctggatctcatctttgtattacgtattaatatattacttgaatatcttcatttttaaattctttttccattatatttttaaattcttttggagttaaatacgttttttcattaattgttatttcatttgttaaagaacgaaatcttactcccattccatgcatccactctataaaatattcttcataaggaacattaaatctattatctattaaaaaatattcctttgatatttttataaaatttttatggattgataaatatattttatataatttattttttgacatttttaacacctcttcgtatttatttcatattaaacaagtataatggcatagccttacacttaaatattataatattttcttaatctttccaactcctctttgctatatctataagaaaaatctattttcttatttttgaatgtacttactaaccataatccaacatctattggatctggattttttattaaatttgttgaatatggtatacaaaaatatttttctttatttaatacattaatattgaattctcctccattatcattaatgcaatagtatatcctgtctatctcggctataatatattcctttctgtcatttatcacatctacagaacaatgttttttcactactgctagcatttcttcacaatagttttcattatatattccccataccttcccattttttaatttcataatttttattcactccctatttatttttagcctttaaaagccataatttttattctaattaattattattgcgaaataaaaaaatcagatataaaaatacctgatttaatattctaagtccattctgtccaataagtatcggtttctccattaccatataatttattaaattcttctaatgtcatttctgactttaaacaatcatcattacagaagtacttcattccaccatctatacaatatccttctgtcataactcttccacaattagaacatattcttgtttctatttcctgctgttctaataattcctttaacttttctttattttctttatccaaaactatattagccaatcttacaaattcttttattgtagttgtattcatactttctcctcctaatattagcttttaataagccgttaatatattatttaattaattattattacttttaaaaaatttattataatttgtccttgtaatatcttaaggtatatattagtataatatataaggagttgtaaatttttaaatttataacttttccttaaattttagcttaaagccataagaaagagtatttatatattatcaatactctttctttttttatattatacatagtgctattattaattaataaaattacttaattggaaatccaatcttttaagctctttaataacagtgtttaattcatttttatatttctctttttcgtttaaaatttttatattttgtatatataataaatataacatccccctattaaataaaaaataaggtactatatataattatttacatatagtaccttatttttatttgatctttctaacatctattttaatttttgtcataatgttttgtgtatcttctttattcaaatcttttcttttaatcgcttcttgaaaaatatcgcttatagcatcccaatcacatattatatcttgttccaataagttttgtatttgttttgttctctctttatcttcactccaaaatttaaagtcagatagaaaatcatgaacatattctcttaattctataatagctgcagcaacagcatcttcttcagtgggtttattaacaataataccaaagtctttaagaaacacagttatactcttatcactttctatatgtttatcatatcttatttttttataaatcaaattagcacctctattttctctattttataattctaaaatgcttcactctattactttttgcttttaatactgtatctgtattattaggtgaatgctcattttcatttaaatctgtattaagagtataagtttctattctatttttacggaaaaattcttgcattaatgatggttcacgattcaacttacgcaaattatttagactttccatactattcataacaaactcaaatatatcatcattagtatatgcccatagaaaatctaaaatattttcattaccaattggattattttgatccaatttatttatataatcccttgtataaaaataatcttttgcaccaaacttatatccattaaaatctttttttataggaaacaaattaataaattctctcggtgttaataaggacatcatatcatttagtacaaatattaaattaaaattatctatttctttttctttcctcactgcagttggatcttcagtattaacacttttaactccataaaaaattactttttttaataaataagtcttattttcataatgtttaggatcttttcttaaagtgtcagcatattcttttaaagcattgtaaaaagcattataatatattagatttaattcattattagtcttttttatcattttagatttgctcccttcatacgtactaatagttctataattcttctaagaaagatatactaatatattaatttaaaaagatcttttcacaacaaaaataacagatacataattaattgtaagtatctgctttattatctaaaattactttattgtttaaaaattttatttcttgtatatataatatatgtagcaattaaaattaaatatttattccccctatatttaatttatccatccatacaaaaggggcttgcgactaaaatatatatagtcacaagtcccttattttaatataatttctatatatgatatatgaaactatagttaaacctataatttatactttttaccatggcaatcataaaaattctttttgcttccacaaaaacaagtatttaatctcttattggattttcttcgcaatttatataattcaattttttcaagtatatttttcacatgttcattttcatttatttttccttcactgattgctatttttatattttcctttataccgggataccatatgtctggttttactagataaattcctatcatataagattcaaatgctttgtcataatttccttttattaaatatacaagccccatagtaaaatgtgcaaccgaatcatatttaacatttatagattcttcacacatttccaatgcttttttgtaatcacccttaatgtaatatgcaaatgctaagttctctaaattttcatcctctcttaattccattaaaggtatagattctataaacttttcttcagtcaataatttttttagcgcaatacgattttctatctcattatcaactatcttaaaagtaaaagttatgtcttgtttttcacaccaaaatccattcttctttttatttatttctatttcaaattttcctgttggatatgaacctgtgcaattcaatatctcattaagtgctttatcaattggatgattttcatttctaaatatattaattattttagcacaataatcatacatcttatcattaaataagaacctttgtatatatatcccatgttccctctcatatacattttttataatatctttactttctttattattaggcctcattttaataaagtctaaatttataaagtaagggaaaatacctaagcatgtactaagtaaaacattctcttcttcatcttttaatagtaaagttaattttgtttgctcttttggtgtactctctcgaaattttttcaaaaatctctcacaaatatctttatcatttgtatcttttcctaatttttttatcttatcttgcatatctttcgaaataagacatggaatttcatcagttctaactaatgctgtatttaaaatatctttgaaattttcttcatatttaatatcctcaaaatttattctatctggaactattgtaacaacattagaagtcatcaatccatgaattcgcaatcttcttaatccccgattactccatatattcatcatattattaaaagaaatattatctgatattctttctgaaaaattactatctatgttaagagttattttacctttactggacatctccatatgtaaattaaatggatatttatctacatcttcagacttatttgtaaataaatatatatctaattctcttctcttagcatttatttcaaagttaaataacatgtatatatctttttcatcataatttatatttggtattatccttaatgaattaatcacacctgattcgtttccaaagctattattaaattctatatcaggatcaggtaatttaatatcctttaattttatatttctactaagctctacagggacgccagccatgcttgcagcagccattatagttccgaaatctgtcatatctaattgtttttctttttttactgtagttattttaaaagttcctatagagttatctacattatcactttcttccttataaaactcttttaattgtttttttttacttttgacatactttccataagtttaaaaaagtttaaagagttttcactcaatgaacgctcaatagattggactgcataaaaagtatcttctgttaattcatttggatatttaagaacatcaatggaaaaggcatgtagcaacccataatctaacgttactctacgatcagcatttccaaattcatatggagtatttctttcatccataaaatactttagactagttgggaaatgtgttagaacttcaattctatcatctttatcaccctcatcatataatacaccaaaattctcattcacatatatcataaagtgctcatttaaacatgcgtttacatacacagattttgtgaattctaactctaaatgacttcctataaataaatttataagttctttaaatgaatttatattcctatttataatatatacacctttttctctctcatagattatatattttcgagattgtaatgcactaatagcatcatcaacatatctttcttctcttttatttgaaaaatgctcataaatcattgcttctgtaacactatcactttgtgccatgaaaattagcaattcttcttttataacctgagatacatcaatatttatctttatatcatctatattaatatcattatcctttaagatttgcttcacttgcaaatgtttttttaatatttcctcatacatctcatttattgcattttctaattcgtgattatatgcaactgcctttatattgatagaattattatatctattgataccagtcatcacttcatgtctttcgtgatgaattaaactttcattacttattcctaaaaactcttttactaaatatggtgctctttcttctaaaaaatctaattcatcagctaacctaatcaatgcagataacaatttaattcttatatttcctccttgtccatatgcctcacattcgtcaagtgaatccaaagggactactctatgactacaagctattctttttattgcattagcctctttcatatctaaacctaaatctcgcttaaattcatcaatgaaatctcctgatctctggttatgagaacttcgaattttttctccatatccagcatcatctataaacctactattaccaaccattcctatatcatgaactaatgtagctacaataagtaaaaacttttcatcatcatttagaatactaagagtttcattaaaacagataccatacaaattttctacacttaaagaatgctcaagtgtatgctcagtaaatgtaggatttacatttgttgttcttgctaacaacggtcttaccatattttgtatagtttcaattcttagcttatattcttctgataatgaattcctaagtaaatatttttttctattttccattaacagctctccttttatttcaaaatactattgaagttctttataacatatttttattttataaccatattttatcatatagtttatataaataaaaaaatatgcttaatattttaatgaaatacgttttgttcctaaaaaattatatgatctctacataaaaatccatatttctaagattgctttcttgtttaaaaattttattttttgtatatataataaatgtagtaattaaaattaaatatttattcccctatatttaattttaatatttcacattccccctccacatataaagggacttgcaactaaaatacatatagctacaggtccctaatcattattctattattgtttttatactttttaatacttcacttattggcatattagcatctattacgtaatcacatggtattatttgaaaattttctttatcatgtattattctttcttgtgccttttgctctgctattaaatagttattagaaacatttccattttcaatatatctttttatcattctatcttttctaatttgcttatctgcttttaaatataatactaatatttctgcatcatctatttctaatcttaattcattaactcccttaacttctactatatatatggatcttcccttatttttatattgctctttagtagcatagtagtgctcatctttatagcaagtataggctattacattttctttaggataatagccattatttaatatatcaatatcattcctatcatttatactatctaaaaatatatgtcctctctcacccttatatcgtggtttcctggttgtatagctttctatataattatatccttccttctccaataattctgctatagtagatttaccggacccagattcccctactaaacaaataattatatctaccttattattttccattatataattcctccttaagtttatttttctgaataaattagctttcttgaatttttatctaatctttttttaaatctatttatatttctttcattaccttgtaattctatagttaatttataattaaaccaactatatttttttataattatatttttaatacttacattataacttccattagctataattaaactatttttaaattgctctaagtcttcctttttaccagtaatgttcaaaatcaaatatcttccctcctatatttttcatcatttttagttcttaccatatacttttttaaaattattatttcaaaaataaaagaattaagcatttaagggctaatagacttacattaataataaaaaattagagattatattaattaaaatacagaatatacagaaactaggtccttatataaattaaagaacctagtttcttccattgcttattataaattaatagtaattaaatccaccttcccattcatttctcattcctatttttaaattaggatatttagatttaattattttaattttgtttttttttaatatattttttactttttttaaatttcctcccaaacttttaatgcctgttcttctgtcatttccattcctctaggacttccgcatgcctgtgggtgtccatcaaattttatgcctgctacttcttttccagcaaaagcatattgagattttggattacagtatattgatattgtcttatagtgctttctatatacaactacaatatcataatcatcttcataagctcttgaaggaattaagctatccttagaacttatagcaaataatattttattattttcttttcttaatgcacaatttttataagcttcttctaaactttcttgaaattctttccctattttaattattttttccgttgaataattaagcatttcttttactacagaagtaacatttgttctattttctgttaccctaggaaagcctaaatctatttgtagcttttgtattcctaattgatatagtaatgctggattaaacttatctctacatatgctagaaccattattatctatttgttctagcatctctaaatttatattaggcaaatctttacctaataatcttaatattcctacatatgtatctgcatccatatgtgtaatttctatagttgaattttcttctgctacagcaggtatttgattattattacaagggcttggataatgtttattttcaccatggtgatcaaagtgctttacattatctgccctccccgcttctattgaatatcctttaaattctggtttacttgttaatattattttcattttaattcctcctaattttagctttttaaagcctttattttttatttatactttatttagcataatgccatataaactttatatatttattattgcagaaaatagtaatcgtactaatttctcatttttataatcaagaaattataaaaaactagaatctttatccttataacattactgttttgctataactaataatattaagaatataacttctaatattattgaactaatcataatttcatttattagtttttctcctaattttttattgcttaatttacttttgttgcccatattattttaatcactcctataattttaacttttaataagccgttaatatattatttgattaattattattacttttatgataaaaatttcttgtttaaaaattttatttcttgtatatataataaatgtatcttcctccattttctaattataaagaaggtgttatatcatttcgcagatatagcaccttctttataaattctattttattttttaattaagcagctaatgatacagtatcatcattacttttaataaattcattcggataagaatttattatctgcctaattttagcttttatattgttattatttttagcttttttgcttctaataaccatattatatatttcttctcttgttgtttcccctcccaaatattctataatattttgtattagagatctccaagttatttgttctacgtctaacatagaaaagattcttttctttattatagtacaaggtattattaactcttgatctttttttattataacaagatattcatgctgtataggtatgaatttattagcatatttaatattgtctgaaacacaattatactgtttttttataataacattttctattttcccataaacattcatttctttaaacatactataataatcacctttaaagcgactatcccctattaataatgctattcttccacctttttttaatgctaaatagcttttatatagtactgtattaaaccatttagtaaattgatttttatcatgcatatgggatccgtcatcaatatgagctacatttccccattgctttccactatatattggcattttagagcccttaaaaacatagtatggtggatgtaaaaacataaactcaaatgatttgggaaattcatcctttattatattgaacccaccaaacttaggatttaaatccattcctaagcactttatatttaagtcctttgctagatctaaagatgttccactacctagcataggatcacaaaattcttttatattataatgtaaaagaatatcttttattaataatccactgcagttacctctccagctattactaccatatttacctctagcaaaatattcagctatacttgttaatcctccaacttttttgaaagatattttttcttgtgttaaatctcctataaatttatctcccattttattttctaatataacttctttttttcttccataatccttaatatcaatatttactatatcctttgttaaatatggatataacttttctaatacctttccttctatcataattaaccctccttaaattttagccataatttagccataaattattgattttaattaattattatttcatcaattctaaattatatatattaaaaaaagcataaagattaataaatccttatgctttaatcttttcatttttatttataatggtgtaaaattccttttttattaattcattaggaattttatttgggccttcatattcgtgatactcctttagtatattggatattaaggatccatatatataatctaaagtttcttttttgaatcttctggccttatttgtttgattattaataattaaatcatcaatacctttgccatatttttcattccattgtaagtaaattattttatactcagtaaactttttttctatggcatctgacatcttttttccttgtgtatatacttgaaaattaccaatcatatcagcatcaaagcaaatatatattggtatttttttgttttttattcctttatactggcaatataaatgaaacttatttattgcttctttatattgctgtaatctttttattttttctattacttctattatttttctccatgttgttactccttgtacactaattgctattactcctctttctgctaatttttcagctttaaatctcccttctgttattgttaagatgggattattagttatttggctaggatatactacatctattggacttcctgctcctgttccaaatttgtatttatccttgttttcctctaaatttgcaaaggaagaagaaaaccaaatttatctttgatcctgtttgttcctttttttatcttttctaatttgaatacctactatttctcctttagtatttcttatttttatacctattcctttatattgtgcaaaagtatattgattcctttttatatcaaaataaaatcctggtatactttctaatattttttcattatatccacatttatttaacttatcaacgaattgattccatatctttcttgtagggaatgtaaaataatctctattaatacgatgtggagcaatttgtctttttgttaataaatgaatataatgtgcactatatatatcacagcagcttgtaaatatttcatatactttatttaaagtatatgaatttgctttaatgctcttctcattattagtttttaccatatattttttttgcatatttttaatttcttttgctttatactttcttttagaaaaatattgttcatattctacactgctaataagattaaattctagtcctatattaaatgcagcttctacataatttactttatcatatagtgctataaattgaattgcatctccacctacagtgcaagtaaaacatttccatattcctttagatggagttactataaaactaccaattttatgatcattatgaaaaggacatattcccatataatgcataccttttcttattaattgtattctagttcctataataatttctagagatatagactttattttttctattaattcttcaagaaattgttttttattcatattgatttccccctaatatttatctatttaaatatttcttattccatttaatttttttagctataattagccatataattcattcaattagttattatttcaaaaaaataaaaagtgataattagatatttgatacctaactatcacttttatgttctctattatttaattttattacttacaaattatatataatttcttattatttcagtgattttatctaaatcttcccttttaatagtattccatgtgaatttcttaagtttataaactagattatcataatatttatcttttttatatttttctatatctaagattataaaagaagattcacctgctccattcacttctcttaaagtattcttaaaaaatctctttttttttttgcatgcctcaactgtaatatatcttctacccactgcttctattattgtttcttcaattttcgatgttctcccttgatatatacatacccaaactttttgaccttttcttatctccatagtctaataacctttctttataataacttcaactcctgcagctgctatttgaaatacaaagcaaacaaaatcgattagcttctttttataatttctatcaagtctgtttcaaatagtatagaggaatttccatccgtatttccatcttcatcttctaaatagaagcctacatattgataatttccactatcaaaagtacctattccataatgcactttatatatgtatgtttctgcgttatctaatatattataaatatcaggtgtatactttatttcatcaccttctttgatttctacaccctttctgtcagataagcctgtctttctagttgtacaaacatttatttcttttccgttttgtatcattctatacaccttccttataccatatttaattgctcacaatatttgtgattatcctcctatctttcataatgatttcagaatatatttgtattgtgcactaagttaactcattgcctgttaactgataataacaaggtttttttatttctaatttttcagctttatttatatcagttgttattataaagttttctattaatttatttttaggtaaattaaatatgttttctgcagctttaggattaactataatagtaaaatcataatctactaaaacctcaagcatcataattgctgtttctaatttgcattttttcattttatcttttaccattttatttttaggaaactctataactttcattgtttttaaatgcatatctctcaaaatatccctccatatttaaactaaaaattaaagtaacccatttctctttgcttttataagtttaaatgcattttctatagattttgaatctttctccgttacaactattttttctttatcaacatgattattaagccatactgtttcattaatccaatcaatttcaataatatatggaatttctccatagtctttagtctccatagttctacctctacctaattaaattcatatcataaattgtataatcgcatctatatattaataaatacttaccatcaattaatattcccgtactttttggaatgtctgtagcaaaataacttacattatctccaacaaatgttgctaacggttttccatcttgggatcttattaaaatcaccctttttttccctgatgtaatattcttataactgtctacaatatttcttaaaaatggacgtgacttgtctttattaataatttctgtagtttttaatgtatctttcattaaatcttgtaatccatcttcttggagaattaaactacttccaacgtgaattatttgattattaccaactgttaggtatataaaattattaaaacaaatgaacaatattaaatattttaataaaaattatatttattagtcagtatttaaaactaaatacctactctaattggatttaacccgaaatcctctatcccatggttaaaaacatttgggaatgcttttttcattatttgataacttccattaacatctgaattaatctttattcctttattgcttataaataaacctctgaatactcttcttgacttattatagttttctttaattggttcttcattatcaagaaaacttgtaccacttgtataagattcttctgtaattattacatttaatcctacattttcagctttatactgtatcttctcaataagtagttgatgaggaatgcctacaaatgattgattaacttttttagacattgaactttctcttttccaatccttattattacctatgattattgtatttgctccacagcttaaagcataatttattacgcttttactagctttgtgaattaaatctaaaatcatattatttcttttgattgttagtttattcattttatttgtccaatctaaatcattcattcttttagcaatttctctataatgagataattgtttgttataatatttattaatagattttaattttttgccactaattatcataggatttattccgcagttattagttatagttgccaaattatctaatccaatatctattgatatatatttattattatcttgttttaatttaatatcattaattttataaactacttctaatataaaatatttatttctaggcagtatcctaacttgttgtaaattaccttttatattagtttttaatttatatttgttaaaacaggtaggcattttaatgtaatcattttcttgtttgcaattctgattagtaaatatgactatatttttaccattcttttttaaatacttaggtaatttaggtctaccactaaatcctgttttatttttagaccatttttttatagcttcaaagaaactcaaccagtttttatctaacagttttaatacttgttgagatacctgagccattaaagatttataatcaacaccatctttaactgaaaactcaatgaactcataacatggatatttattatctttatcaaaatatttaatggtttttaatttcttcttaaactccttattttctttaaaagcttttagtttagccttcctaaaattaaattttcttaattcattaaattcatctactttagcattaatatcatttaaataatctaattgttctttagtaaccttctcatctttagctaatttagaagtgataataaatatttgcctaatttgataattagcatagttataaagatttttagataagaaacaatatctatctaaataatcatatagtttatgatttggttttataatatgtttttctactcttgacaaggtatcatctttctttttaatcatcttcatttacctcattttctgttaatatctcttttattttttgtccttttctttttgaatataatttcattgaatagcaatgtagtaaactaattatttcttcaaatatttcttcactatctaattttttagaacctatttcactcatgacaactatttcacagttatattttttaaataaatgaaaaaataattcaaaacctactcttgatagcctatctttataagttataacgactctttctactttcccactaactatatcatctaacatattgaaaaactcttttcttttttcaaaactaataccgctagcaacatctgaaaaaactttagatatgcaataaccattagaaaaacaaaactgtttaagcatattaatttgattttctaaatcagctttttgcttatttgtagacaccctagcataaatatacgtttttctatctacacctttgttaaataatttataaactgaatctttatcatagtcatatctgccattaggtaaagttgtagtttttataattccttctctaacatatttagtaagagtaggtcttgttatttgtaataattctaacacttccttagatttcatgtttaacaccttcctatatgataatattaccatatgtttaatatcgcatcaaacatattttattaaaaattttaatattttatattgtttttaatgttttaactatccatatttaatacacttgatttttttattgtttctcccttttcatcctgctctttaaatttatcatctaaagatatacttatacttttaccctctatcctatctaatggtttactttctttgtcgtatgttgttattattgcattcctacctttaaaatgctcttgcaattgtttatactcattttccaataaattacaaccagaaacaataaataacgaacttactaaaactattgaaactataatgctttttatttttgttttattcattttaaacatccccttcacaattatttcattcatagatctaatctttgaattgtggaattaaattattttcaactgtttacctttttcaagatgtaattttattctttccttagcttcattgcagtgcttcttttctttttctatacaaatataatttctatttgtatttatacaagcttcagcaagcacacaacttcctgcagtaaaatctagtacggtacctccctcatttgtataagttttaattaaatattcatatagctctactagcttttgatcttttatcttgattgtgttatatggaatatctattatagttgttggatatcggtctgtttgacctccaccttccatacctattttagtcttaccatagttggcacctgcggtagtgtgctgcttatatttctttactggcttatgtccgtaagtcttctatggattatagactggtaaccttttataaaatatagggatatctatgtgttgtcttaaaggcatcctattagcatttaagaaatttgatttttctttaggcttccatatccatgaatacctgtagtactttttatttgaaactactaactctgatgtaaatactccagctgccattaatgctatagatgcattatcttttgcaattctatttatctcctgccacattggctcaaaaggaattgctttgtcccattcattattagtcattccaaatggtaaatctgataaaaccatatctattgatttatcatctatttttttcataatttcaaggcaatttcctaaataaatattatttacttctagcaatatatcaccttcttttctgtcaccttaatttcattttttcatgaatactagccaatgtgtctttgctcttttatttcccaataaaggtttataatctataacttttaatatatcttttatttttatttgttcttcattccatttaaaaatcaatattccgtgtttatccaagaccctcatgcactcattaaatccttgtcttatatctattggccaatcactatttaactttccatatttcttggccaaccatgaattttctccagcctttattaaatgtggtggatcaaaaactactaatttaaaggtattatctttatatggtatatttctaaaatctcctagtatatctggctcaataataagctttcttccatcacataatgtatcttctaactctctgttatccataaaaataacatccttattttctttatcaaaccaaaacattttacttccacaacatacatcaagtattggtttttgcaaatttatcacttcctaactattgcacaataatttcataggttataagatacacctacgcttgaattgtggcattacatcattgcttctaaatgtaattccctatacatttccgattcaaatacccaatctccaatatctttatcttcaaagtcacaatcatgcgtattgtaataatattttccatttttcaattcaatgctacacacttcactttcaaagaatctataatcttcgtctatcatataggcaatatcacctaattgaaataattgttttgtatttttgtttactttttctattaaattctttagctcattaaactctaagtcaggtcttttggtattacatagagcaattattttatttttttccttgtctaaaataaaagcatctgtaggattttcaattacaagttcatactttttcatccccaattcactcccttacaataatttcattcttagacctatttttcaattgtgacttagctaaatcctaaatccaaaattgtccattgttgcctgtatatcaccattaaattgaaaataagtatacaagctgctttccttggttggtactgctccaaaaaactttaattgatttattaaattaccttcttttttattactgaattgaacttctgttttattttcacctattaattttactttcattttatcccctccaaacttaccattttatatcttctttaaacattttataagttaataatacaaaattatctttcaagatgtttacagaaattatttcaagattttgattcctttttatgaaatcttgataatcatacactgcttctaacactgttacccctgtaaacaattttgtttttatcattaataatcactccatttgtttactttgtatttatttcatagttttaataactctttgaataccttttttaaaaatttaagttgttctttattgaagtggtcttccttgaaactatttcttgagccagcacttataataattccaatagcaaaagaaagttcctcagtattaagagtattaaaatctaataagcaaggctctgcatatatagcgttccatatctcatcttttcttttaattgatatcatttaattttctcctctctaacttttattagatttattttgcaaattaatctaagtttttacttatgccctgtttttgtcttagaattcttgtttttaattaatatactggtattataatttttattataaaaaacactagtaaatttaatattaaatttactagtgttgtatttttttacgataaaaattataatatagctaagagaataaaattatgatatattttgtaccatccccaaatactattattctctctccaaaagaagttgttggttatttttgggggtggtaactagtggatagggtagacataataatactgtcacttatatcattgatagtattaattatagtattatcaatggttttacctaaacaaaggaaattacaattatttacattaaatataaatatcttttttataaaaataaatttaaaaatttattacaaaaaataaaaaagtgtaaatacataccttcacaaatgtatttacacttaaactgagaaatatatcatattgttaataactaacaacttctttacctacattataccttatacatttattaaagtaaatatgatattaaactataacatagcaccctcctaaattctattgtattacaattattgtatacaactaatgaaaattttcatttactcttttatagccataaagtatatcttataatttattataatctttttctatatcatattaaatttgtgtatttttaaatatcttattagtactgttatagtgagtttctatatctcttgttatcattacttttgcatacctaccaattacttgatcttcgatttctgaaatatcgttttagtttttcttaacaacctgcagttcaaatgatccttctctatctcccggtaaaattaaataagattctcctaaatctgacaatactttttagaactataatcacgcctactatttgaagtgttttgtttttataatcatatttagaatatcatgaatgattgtcaagcttcgcttctaacatttctttaaatgtattcgtaaataaatcctctaatgtttattaagcatcttttgcacttgtagttttaattgtttaataaattcttttcttgaaaaagacataatctgtgaaaaccccataaaaataatataataatcgaaactttaatttatacaatataaaatcataaatattttatcatttattaatgtctattttatctaagctctcaaatcttactaaattatatttcctattgcgaacccttaaacctctctattaaaaattatagtattctttttaaaaacatcgtattgctatttaatataaaatatttgggatagtaataattctgcaatcattatcctaattactatcatctattttcttagcatacttatctcttattttttgtactaaagtatttcccatcattcctgattcactatattattgtatctctattatttattagcattttcaatagcaattattgacttcatatttttaataccaatatataataattttttgtacataagatatattcaaacaacttataatgaataagctaaaagatgtagtttatttaatattaaaatttagctacatcctttaaatttaagattttataaacttaaacttttcttatataaaataggtttgctgagcatatagttatattattcagtccacccttcatctttaggaataaactgccaattacatcccaattttgaattatatggtttcctttttacctcttttaagtaccatttacttatacaaaaataatctttatactctttaaatacaattccagattcgtagaaacgatgaataccaatcaatcctatctcatcagtactttcttcatcttttttaaaaagcaactgacaactatatgttggctgttcatcatattcttttatttgtatagtattgtaaaactcatcagaatcacttataggagctaaaaacaatttttcttcctctttcttaaaatatttatagatatatactctccactcttgatttaaattaaaaaaatctagatatatataatcttcttttctaactatatcatcatttatagattgagaatttgactttcttcttataataaatttttctccaatatataaatctctataatttatatatttggaattttgattatatttgctacgtgttaaaatttcacctacaggtgaatctttctttagtttaatatatgaatttttattcccggcattaaacatataatattctttattgtacattaaaggatttccccaaaaatcttttaaatattcgctatatgattgaattttatatatttcttcaatatttgattgacttaattccgtattaaaaatactgaaatatttcatccaaatgaattgtgttctatctatattaccatctaatttaaatattatttcatcattagcaataacttctcttatatctctaatatctatatgtgattctagcttaccattaatataaattttagcgttatccgaattattagtaatagttacaaaaaaccatctatttatatactctgatatatcttcttttatgctatattcaaaaaatactgatttgatttttccatttatatcaattaaagtccatattatcatattacccctaatagatattttccatccagaattatttttcatacaattaattattgtatattcattatgaatataattttgtataccatcattcttatatttaggtattcttatccaaaaactaacgctaaaatcaaggaacatactattaaatatgatattctgattttgaatcactctaatcttactatttgctgaactagttaatttaaattgatttttatcattaagcttgaccccatcatatacctctacctttgccccatatcctgataaatctattaacttattatccctatatcttaaatttaagataatattatttaaaatatcgctattatatttattaaatatttctattagtattgtattattagtatacgttgaaagatcaaatggtatactggttttcaagtatttatctacttttgatttttcatattctgcacttccaatcaaatataatttattttcatctatataatttaataaattttttctgagagtattatcgaagtctagtaatttttctacagctaatggaatcatttttttcattaaatatgatacagaacattcatttataaaattatttatattatctatagcttggttaataccctcattaagtttagaatttacatcattaaaatcgatgttaatatttgacctttctttctcagaatatatattatatttgtattttattatttcttccaatgcttgtgcttgataatttaaagccttatacattccctcttttattgtataaaattgagtattaactgttgagagccattgcgctactattaatccgtacatatcaatccatttttcatctcttttagttaaagcactatttattgtttcaataattttatttttattgtcaatatatgattctaataaaaaagctccaactacaggtattaaaagttctggtataaattctagtagaatactggctcctgcaatctcaaaagcattttcaaaatttcctttagctgtttcatttcctacatttaaagctaatcctatataaggaacaattagagatatatctgcaattttatccatagtactgcttttattagcttcgattacaaaatcatctactatctgtttcacccaacctgcaaataatcctgcttctaccactttattagcagttttaatataatccatagaaaaaaatgaataaactttgttagaaaataataatgcatcatcaaatgaagatgttaaacttatatctcttatatctagaggaaatgtctgagagtataaatattgaaagatggtattttcatctgtaaaaattttttttatagcgggttgttttttatattctggaacatatacattaaaatcagtaagtgattctgtattttcacttggtaattctattttacttattaaatcagtatctaaaattaattcatttatagagaaatcattgtctatataattattctgtgtattatatgctattctttcgtttttagataaatcatctgaaaaactatttttatcagctataaagaacaaatcctcattatcaacatcaatacatattcctggagctttaacacttttacacatttgtatcttatatacagccaaatgctccttgctgatttcttcataagcttgtttatttatagctttattctgacctctatattctttttccatatttttatcagatatattaaacccttcctctatagtatagatttcattatctaataaattttttatttttactggtggtaaggaatcactaaaataagaagctctagtttttattttataattttctgctatattagtttctgtaaaaccaaacattaagcttttatataatttatcgaaactttctacatctatactatattttccttcagaatcttcaacgaatttatatttatctttaaatttatttttatatatattaatattaatgttaggatctgatatgcaaactaaaaccttgttaagtctatcaactatccctctaaaattttgcaaaactttatcatagatacttttatccgtagaaggacttatgatgctgggatcttgccctccaaatgtatatagttcttctgcctgtatagcatctgtagattgcataaaaaattttttttcatttggcacaattggtaaatcatttactttaatgccatataatccatgtaaaacatgtataagttcatgcattagtatcaaggctggatctgaaaaatatccacgtctattaaatatacttgcgcctttgttttcttgaacattattaaatacgcttacatattctgggcaaaacttcatttgcattatacccccgaagccttcccttgatgcaaaatgattttgtatacctatatctatagtctcattttcatttaaaactggcccaggtccaaatattattaaatttgcaaaaatacctttttttcgctccacttctcctggattactaattaatttattaacagttacactagcaatgtttgtgttaaactcttcgagtggaacacgtctatctccaagataaggtataccatttataatcatttctaataacttttcacccaatggttttgatttgattctattaaataacttgatcattgtttgtaaaaatatattttttttatcattagtatttaagtaatctggatcataatattcacaaacatctctattaaaaataccggaacttttattaaaatcctcaggtttatacccaaaagtatatctttccggtattatccaaatacgatctgtgattttaaaagctttataatatctccccatacctctcgcaaatggaggttccatcataataatattattattatcaataggatcattataattaaaattatttattgtaactggcataaatattctcctccttattttaagtttatatcccttttaatgcccataaatgtgcagccttaggtatattgtcattattattacatatcatccaattataatttctatctcttaaggataaagataaatatttattattataagcaaatgtaaggcaattaggcctaaatatatcgttattaaatattattctctttgcagtatctttagagctaactaattggattctattattttcagaggatatatctacatatttttcttcatctcctaataaacaaactactccttcatcccacttttgaacatattgcttgtttgcgtcaatatttattaatttaaacttagcaccttgaatattaaggttatttgtatctttaattgacaaatatatattattgttttcagtaacttcatataacgagttttctgggaatacataattgtatagttcataggttttattatattctaatctttctccagaaatatcccttatatatgagttatttaaataagaaaaataattatttacaacttcttcactggtaatagatctatttaaaatagataatccttcaatatatattggattattttcattaactaaagaaattgtattacttgaataaatatttaaaatttgttcaatactttggttagcaataagtttatcattaataaatattaataattgatttcttaatctatctatagaaattgatatataataccaatttttacttataacatcggataaataaatattctcttcattaccattgcaatctacaatgctgaaaactaatccattattttcaaaataaatctcccatccacaattatcagctttattttctattagtttagacgtaataatatcttctcctaaatttcttaaccaaaaacaaattgaaaaactattagttaacccattttcaaaagccttattagaaaaactaacactttcatcaggttcttttaaatataatgcatctccatttactccataaactaaactaatagaatctgaatatttaactaatgtattcttaccagatatgtcttcaattactttattattatcttcctgtaatgtaaataaaaacagattataatccgactctttttcttctttaattaaatcagtttcagaagtaattaaatctttaatactttgaatatcaaaaaactcaaaatctatattcataaatgtatttaatttaattaattgtaatttttcatcttcagtgatattagtgcacttttgtataaaagctgttacattactatttacactattaatacattgttccataaaagaaataaacttaggatatatatttgtatcaaaaacacatatagctgatttatttaaaaagtcatttatattatttattgctatttgtgattcatttgataaatctataaaagttttctctgtagctaagttcattaaatttaatttatccattgatatatcagctttaaataaatcttgaagcttattttgtattatttgtttaattagcttttcttgagctagtattgactgttttgccatacaaattaaatcgaaatactgactataatattctgtccaccattgatctaagaaattgaaataaacttttttgaaataaagtatgttttttaaatatatgttaaataatttttcatttaaatcatttagtggtaatcctaacatatcgttagggattccataaatctcaattattggcatacttaaattttcttttttattaataagtgaaattggtcctaaattttgaaattcttctacaaaagaatcggatgtatttaaaatatttaatgcttttccaaaccaagttactactttattaataccgcaatcagtattaatttcttgagttgcagtaatatcaaaagaataatttctaaaaatctctcttaaccataaataatattttttatctgtatcaataggactattatcctttatggaatctaaataaaacattacattagataagaaagaatacactaaagatttatctttagaagaaactacttctacaaaatctgaggataaactaaatttttcattgttagtattttgagcttgtaaataatttataggccatggtatatttgtattaatttctctagtacttgtaattttctgtaccggtgaaaacttatcacaattttccttataaggatttacatctataatctctggaatattgtctattactccaatgttaacattatctaaagaagaatcatttgaattattaaaatgatattcataggctctattatatgggattttataattactgtaaaaatcatctacagtgctttttaatccatcaccataaatattacttctcattaatgaaacattatttccatttaataaattaattatttcttcaggtttatttataatatcttgatttctatctgataaagataattgagcattaatttgaccattaacaaaaccatttatactataattttctggataatctattttgtagtattgttttctataaaaatgtttaagtgcattattaaatctatctggcatcataatgctaaactctttagagaaataatttaaatttaattcccatatatcattgatattgattcgaaacttttgttttaatctcaattttatatcattaccaatggcattatttccttcaatttctgtttcataaatattcctatgatcttcaaacactttttttgcatttgagaaataattatctgtaaaccaatatggatctgtatttataaatttaggatcaatgcctccagatactagtaaatcaactatattcaattgtgagtattctatattctctaattcacttcttaatctatatggaataactaaatcatcactcggttttataccatataagaaataaagagattttattaaacattttattaattctattgcaggatcaatataaaattcgtcatatttataggttagaaatggttggaaccatatttcagtcattgttcccattccattttctgcatcttcctttttataaaaaacagtattgttttctactatgtttgctcctggaccaaaaataactatattagatgcatagaaacttttattatcttcagatgaaagataatttgtttctctatatcctgcataaggaaatggaatagtacttgaaattaaagaattcaattttttattagattttggtgctgatccaaaagtaatcatattaggtgcataataccccccacctatatatccataaggaaatggaatagctgtagaaatcaaagataataacttttccccagcgttagtactattaattctttttaacaaagtaataatggcttgtaagaacttatctttttcactatcttgtgaaagaaaattagaatcatatattcccccatcaactttatattcttcatctatactcaaagattcgccataatatctctctggcgccacccaaatattaggagcaaccttaaaagccttaaaaaccgtatcagtttttctagctctaactactacaacatttttattatctaccggggaatttatacttaagttgtcatttatattcatatctaaccaccctcctaaatttatttcaacgcacatacttttaattatttactatacacgcccccttaaattttggatacatttttcagtatattcttatcatttatatataacatagccacactattttttgtaaacctaaaattttttaaaaatataaactacatattaattaattttttcaatatgggttctaatctctctaaagccattattttatttttatatacagattgacgacttatattaagttttttagctatatctatctccttaatatcttcaacaaatttcatatatataattttcttttgatcgtcaggtaatatggatattaaatcattaaactcaaattctgaataacttgaataactatttgctattaagcttaatttcttatctgcaatttctgaattatatattattttcttatcaatctttcttttattgcaaatatctaagcaatatctttttaaagtcctactaatatatctctctaaatcattttgtgtattgaaattgctcaaatcaacttttttaagtgtataccataaatggtacaaaatatcattgtaattatcatatatattatattttctagtaaatatatttatagttttttcaaaatgcttaaaaatttcttgaaactcctcattgtcattttttaacatttcaatttgtaaaaacaacttattcatatttaccactatccctccataatatacatattattgttttattatactataaatgaactaattgcctttaaattttaataagccatttttacgaaatatccataatcaattatgtaaacatactaataaaaatttgatatatttaaattttaggtttacaaaaaataatttgattatgttatatgttatatgtaagattaattcttaaataaaggaggaatcataatggaacactattcagtaatccaaaattcattaaatgacaaaattgttaccatctcctgtaaggccgatactaatttatttttttatcaagttgccggtaacgttagcttatttcaacaaactagaaattaccttgaaagatggagacttatatatgattctaataaagctgcttataaaataaaaagtatggatatccataatactaatttagttttaacatggaatgcaccaacacataatatatcaacgcaacaagattcaaatgcagataatcaatattggttattattaaaagacattggtaacaattcatttattattgcaagttataaaaaccctaacttagtattatatgctgataccgtagctcgtaatttgaagcttagcacacttaataattcaaattatataaaatttatcatagaagattatataatatcagatctcaacaatttcacatgtaaaataagtccaatattagatcgtaataaagttgtacaacaagtggctacgacaaatctaaatgttaatttatatacttgggactatggtcgcaatcaaaaatggacaattagatataatgaagaaaaagcagcataccagttttttaatacaatactttcaaacggagttctaacatggattttttcaaatggtaatactgtaagggtttcttcttctaatgatcaaaataatgacgcccaatattggcttataaatcctgtttcagatactgatgaaacatatacaattactaatctacgcgatacaactaaagctctagatttatataacagccaaacagcaaacggaactgctattcaagtatttaattctaatggaggtgataatcagaaatggaatattcgtaacccataaaattaatatcaacaaagatttaatatgagtactatcatctaatttataaagaggtgaattatatgtcagttgaaagaacttttctacctaatggtaattacaatataaaatctatcttttctggttctttatatttaaatcctgtatcgaaatcattaacattttcaaatgaatcttctgcaaataatcaaaaatggaatgtagaatatatggctgaaaatagatgctttaaaatctctaatgtagcagaaccaaataagtatttaagttacgataactttggatttatttctttagattcattatccaatagatgctactggtttcctattaaaattgctgtaaatacttatattatgttaagtttaaataaagtgaatgaattagattatgcctgggacatttatgatactaatgaaaatattttaagccaaccgctactcctattaccgaattttgatatatacaattcaaatcaaatgttcaaacttgaaaaaatataaaggagaaaagtgtatgaattcatctataaaaaaaatttataatgatatacaagaaaaagttataaactatagtgatactattgatttagctgatggtaattatgtagttagaagaggggatggatggatattatctagacaaaatcaaatattaggtggaagtgtaattagtaatggatcaacaggaatagttggggacctacgtgtaaatgataatgcgataccatattattatccaacaccatctttcaatgaagaatatataaaaaataatatacaaactgtatttactaactttactgaagctaatcaaattccaataggatttgaatttagtaaaaccgctccctcaaataaaaacttatatatgtatttacaatatacctacattagatatgaaataataaaagtcttacaacatgaaattatagagagagcagttttatatgttccatctcttggatatgttaagtctatagaatttaatccaggggaaaaaataaataaagatttttactttctaactaatgataagtgcattttaaatgaacaattcctatataaaaaaattttagaaactactaaaaatataccaactaacaatatttttaattctaaagttagtagcacacaacgagtattgccttatagtaatggactatatgttattaataagggtgatggatatataagaacaaatgataaagatttgataggtacattattaatcgaagcaggttcatcaggaagtattatacaacctcgattaagaaatacaactagaccattattcaccacaagtaatgatacaaaattctcacaacaatatactgaagaaagacttaaagacgctttcaatgtacaattatttaatacatcaacatcgttatttaaatttgtagaagaagctccttcagataaaaatatatgcataaaggcttataatacctatgaaaaatatgaattaatagactatcaaaatggaagtattgttaataaagctgagtattatcttccttccttaggatattgtgaagtaactaatgctccttcacctgaatctgaagtagttaaaatgcaagtggctgaagatggatttatacaaaatggtcccgaggaagaaattgtagtaggtgtcatagacccatctgaaaatatacaagaaataaatactgctatttcagataattacacatataacattccaggtattgtaaataataatccattttatatattatttacagtaaatactacaggaatttataaaattaatactcaaaataatctaccaccattaaaaatatatgaagcgatagggtcgggtaatagaaatttgcaagctggcaatttatgtaataataatattaaagcaataaattatattactggggttgacaaccctaatgctaaaagttatttagttgttttgcttaataaggataaaaattactacattagagtaccacaaacttctcctaatatagaaaatcaaataaagttcaagagagaagaaggggatctccgaaatttaatgaattcttcagttaatataatagataatcttaattcaacaggtgcacattactatacaagacaaagccctgatgttggtaactatatttcatatgaatttacagtgcctggtaactttaataataaagatacatctaacattaggctttatactagtaataatcaaggaataggtactttatttagagttattgaaactattgacggctataagttaattggcatacgacaaaatttacacctcttaaataataccaattcaatacgtttattaaatggtgcaatttatatattaaaagtagaagttacagaattaaataactataatataagattgcatatagatattactgattaatatattacgatttattattaaataagagtccaccagcttatgaagtgcactccaaagtttagataaagatctaaatttttggaggtgcatttttgtggcaaagaaaatatattcaacttttcaaattaaagctatagtatatagcttttctaacaaggaaatcatattttggcttattttaaactcacattttttcaccaacgccatattatggcaatgtaatcaagaggaatataactaaatgtctaaatattaaaacttattagtttatggattttaaatatttgctttaaatttatattattaattagatttttaatgttataaattattaatatttctaataaattcattttttttactgataaattaggaacagctaaaaaagatattaattttttatataaagaggtatagaatagtctaagtatgttataaagaccattccattactattatttgcccctatcttctataactttactatctaagttttatagtaaaatacatgttatctagcaatgattttgcttcacattctatatttttttaatctagttcccatttgtaaagatattccttctttaatattttttataaaaaaataaagtaattcaatttaaattactttacttaaataagccttatgattatctgtttaaaattaaatgtatacatgcaaacctcactagatataattattactaatataacaatagataaatatattaaaaattctatgatatattttttatcacacatactttgtaactcctataattgattttattaattataagattattattacattatttcttctttattttataatagttttttctaaattcttttggatattcttaagttcttccgggaacacaggtctatactttaattttaaatcttctattatttcatcatcaaattcatatttttgttcatacaagcctacaagagcttcaattatctcaattcttttataaatatccattctatgttcttcacttaaattaacatttgcaaaagattcctttaaataattataatattcattcacttttggatgctttattttcataaatcattctaacctttcttaacattttctattataaactaatttagttgcgattatatgcgaaattttaaaatgcataaattcacctgctattgttattttgtttacctttaaaacctcccccgtctttccatttaaatatttaatcaattattatatatactaatttttctaaaattaaacacaaaaaaagcatagaaataaattcatatgccatagcaacttatatatatttattatttaatataataataatcgtactcttttattggatttattctttaaactatactaaaatataataataagaagtagacctaagtaaaaaatttataatggaaataaagtttaataaaaaaatataagtagataaaagaacaaattatgctaataataaaaagatacatatatagctgcaagtttattaaaaactaaaaaccgcgacgttgaaaggaggaaaaagtaaaatctatggatataccagatatacccgaatatttaattgaaactatatttggaaatatagatcaacggctaaaacaaaatttctataatttttatgaaaatttatttaatatgaataataaagaagaaaatttaaaattattaataaaagatattatacaaaaagaatttatggtagctgaactaaccaaaatatcagatatggatttacataaaacaaaacatacttttatagctcctgataaaataaacaaactaaagagatataatttacaacaaataaaacaaactaaaaaaagatggtataattcattatttaaaaagaaaaaaacaaatccatttaacattgaaattgaaactgctaataataatataactttatatggtcctgaggtattttttaatttatacaaagttagaagtattgaagaattaaaagatattagagcagctcaatttaaagattggctagataattctatatttattacagatttcttttatttaaaaagtaagacaaataagcagattaatacagcttttaatttagattttatatataatatctgtacaataatctatgataaatggaataacaatttaaactttatatatatggagtacccaaaattattattggatcatcctttagttgcggatgggagcgggaaaattaaagtacataaacaaacaattattcagcaaaatcaatctaataaagatgttaaatataaatacaacgattatgtctctaaagatggaataactagaatattagttcctgaatctaatattgatactaaacaaagtagacttatagacaataaagatcttaatatattatctaatattcttaaatataaaaaagcagattttctgaccaataagactatagtctttaatttaattgatattataaataatatttattgttctaaaactgtccgttcttatgaagacttaagaaatagaattgcaaaaatgacattattgaaatttaatttttttagaacagataatacttctggcatccctgatgctgtttatgggattttttctagttacgagtatttagataaatctcaaaacagagttaaagtttatgttgatagtattttatatgataaaatactaaaaaatcaagtatatacaatatataatgataaaataaatcaattgaatgatgattttgctaaaacattagtaatatatcttcaacaagaaaagctagtattatatactcaaggtaaaaatacaactttcttaagttatgattattttagtaatttagttagatttagatataaaaaagaagaaagaaactataaaatcattgctcaagctctagaaaatatgaaatgtaataatataattattagagattttaaaaaacatatgaatggatttataataacatttttagatacaaatcaatttgaaatttccgatttattttccaataaaaatacaagtgacatactccccatgatataaataattaccaaatactcccctacctatctggtgtgggagtatttttttataaagaaatttattacaatttcaaaaagtgtttcatttttatcgtgcactttttaaaaaatgttttatttttatcgtgtactttttaaatacatttagtattttttataaggaaaccaaaaagtgtttcacttttatcgtgcactttttaaatatatcattatctattcctatacttgtcctaattcattaatttttaagaaaaatttgctaataaaattcactaattttttataaaaagtgtttcacttttgtcgtgcactttataaaaagtgtttcacttttatcgtgtacttttataatttataattttatacattattataattgaaatttatactatatcttataaaaagtgtttcacttttatcgtgcacttttatgatttattctttagttattttattatatttaatttgaacactagtgattatatagtgttcaaaaaaagtgtttcacttttgtcgtgcactttttttataatattagattgttgtatttactttatttgttcaaaaagttgtttcacttttgtcgtgcacttttgtcattagacaaaatttattctatttgcaataataaaaaatgatctaatatattacagaaaggagcagtattttacatatggcattagcaatagaaaaacttttttttaatgtaagtaaaaacttaatacactttattacagagccaataccattatatcactataagacaatttcatttaataaatgctgttattgtcctttctataaaaaaatgtatgataaaaacatacataattattgttccaattattgtaataataaatataaaaaagtcataaaaaaatataacatttataataacataaatattgataagactcatattcaattttctttaacacaaattaaacaaatgctaatttattattattatgcaaattctaagggattcgtttctttgatatctaaaaaaagaattgctaaaatgataggttgttgtgaaaaaacagtagatataaataataaattattttcagatttaggcttaattttaattagcggtactataaacaacaaattttctctaattattaaagattactctgaacactatagtaaaaacaattcagggtatctcaatttggctacgaatgtttttaaagacttactacatatcaacaatgtaaatgctctaagaatagctctccaaggcatattaaaacatgacataaatactcttttagatagggaaacatatttttctattaataatatgaaaacattcttaccagactacataaattgcaaatctgctatagaaaaaataatatgtagattaaatagtaatacaataactatgctttttaacagctctgaaaagcttatatttattatctctaaaaatctacatggtaaattactaaaaaaagaaatgtattataaatataagaataactttttaaattatattacagaaaacaatattaaattgaataatttaagtcattctattaataatattgtaaaactttctttcgaatacgggtatgatattgttcagctaatgttaggagaaataaaggatatagcaccaactatatttaatgttggtggatatataagagataaaataaagagatacatttatatgaatgaacctttttttgcaatataaattaaggtctttttgtcatgcttatttttaagttttattattcattgtttacaaataatataaaaatttacattatccgtaatataaatttttataaattgttctcattaactatttatttccattccctgttgataactttagaaaaaaatcattaacatagataattaaataaattacactaataataaaaactattaacataaatacttaattttcaacattaagaataaaaacaattctaacaattcatatatctactgatattactatgttctgaaacaaatatttatgattaatatttgtattttaatatttgttctttaatagctcttttcatctctaaaagggaagctcaaattttctatatttattaaaagccttttattcagcttaatactatataattttatatatttataattgtatttaataaaacacttaaaaaaggctgtaatttagttttcataaactaaattacagtcttttttataaaactaacttaaaattactatcaataacactaatagtatatttattatcagttcttttttcagctattatatactcatttcgaatagccttttttattatatttataattttttctttaaaagttgggctaaacatttttaagcataaatcaaaatccatttcagctgatgttattattgcataaccagcttttttatattttagaaaatcttttttattgattttaatataatgcatatgatctttttcttcagttgtaaccaataatacgtttgtttcattattgacgtaatataatatttccattcttaaactgcctccattttcatattctttttgtctaaacctttctctattttacgcaagcttacaatgccaatccctttaaactgatatagttgcttttttgaatacgttgatagatcttccaatgtatttatacccatatttctaagtgaattataggctcttattgataggtttagttctcgtaattcatctcttttgttttttctcattttcttatttccccctaaaatcatattattttgtactttatcttagtagctaggcctcctcttagatgtctttcagatttattataatctaatactttttgcacctctttagctacttcaggattgattttaggtagtctttcggttatatctctgtgtattgtactttttgcaaccccaaatactttagctgtttttctaacagttgatttagtatttatcacataattagatacatccaatgctctttcctttatataatctttcatttataagattcccctttcttttagcttttgccaacttctttatttcctaataagttattattacaaaaataaaaactaggtatatattttatatacctagtttcacaaatttatttttttgtaaataagttgttatcatctattctttccgctattactttaactacttcattgaattcgtttaaagtcataatattttttaatacagacttccaacctttccttaaattccatattgaaatacagctatttattccaccgccatttaaatcttcattccgcttaattcctttagagcattcacatttttctataaatccagtttgtttcaagtaatatagatcacttatactggacaaacttgttttatattctaataattcaatatattcttctgttactaatattttttgattactattcaatttgttaataaaaattttttccattcctacaatcctttccatctaatctgatataatttttaattttattttttaaaccatgtaaatatataaattactattacaaaaactacataataagtaaataaaagtatcttttaaaaaatacttcaatatctattgcgcaattttttattgttctatattaatattacgttaatactgaaaggttactatatttaatttttttaatatagtacttttttattcattacactttattttctatttctatataaagtgagttaatttaacttattaatgctatattatttatactaataatgattaataatgcttttatacgtgaactaatataaagacatttaactattaaagtttacattatataaactatgatatataattttaataagaaatattgcaaggaaggatttaataaatgtatgagaatttagatatttttcaatttggagagtatattattaatatttttagtgaaaaaaagtatagagagattgatgtgttctttaatgatatgcatataaaaattgataaagaatctactgctaataatatagtacaaaattatacaaatgaaatagttgacagttttcagagtacaagtaattgtaataaaatttattctatatttaaaagaaaagactattaatgtatagaaattatcattaatagtcttttcttttaaatattttataaactaccccatttgtctttattgttttctactaaattaataagtgcatcatcttctttgcttgattgattatttttattagtagtaggttttttaggagttattttttgttccatattttctgacaatctattttttatttcattaaattcttctggatatttttcattaaaatactctatcagaatatcttttattttatttgatctatttcttttagtcgtaatatcatttagaatttctaatatagtcatatctaatacttcatcttcatagaaggcaataacacttctatttagcggctttgatgtcattttctttcaccacttctaacttatcagcatattttatattgctatattctttcaagccttcagctattgtatattgacttctattattttgtactaataatggaattttatatgcttgtttaaatttatctgatagaatagttttaaatgtattattatttaataatccacctgaaaaaatgaaggtatctactgtaggcatatatttatacatgttattttctatagtaaagaatacatattctgcatattcttctaagcatctatttaatatattttctatttgttgttcttcaccatataagctataattaccgttttctaggatttcttgcaattgactgtaagagtaataagtaatttttttatcttcattttgtctaattaatgcttgttttaagttattataaattcttatgcagccttctccatctagtaatgtatcacttgccataacagtttgcatgttcttaacaagcattaaatctaacgtagaatggcctatatcaacagagaaaatagttttattcatatcatttctaggtaatgtgaatataggactataagcctgtggtaagcaagtaacatcttttatgtaaactttctttttaacttctccaaaattacaaagataactaaattcaaaagcagatccttttaaccaatcttcaaattttttactatctccttttgatctattaggtaatccaacacatagatatagattaaattcagattctttagtaagttgtcctactatagatagtaattcgattaaatgatattcatctttaattctatctctatttaatctttgcatagtatccgggtatctttctatgcatgcatctccacaaataaaatatttgccattgtattttattaaggtatttttattattcaattctttaatggtatttgctatatttaaagcttctttttcagttatattattgatgtaatttttcattattacttcagtatcatttgtcatacctattccatatccaaaaccagtatcaacaccagcaattatatttttcataaattaatccctcctaaatatgcttgtccatataattttaacataaattataacaaaaaatcaataattatcattattatttaattaaatataaaaaaccaatgataaaacacttataaaacatttaaagtttttttatgttttataattaaaataataatatttttatgattttaaaatatattaaagttatataatgattataaaacattaaaacacgatataaatgttttatggtgtgttttaataagtaaaaatagatttacatgctttttaatgctaaatataatatataaatcatatctttgattaatttatatattatgtttaaaaactttaaaaaactgctacatttatcatttataaatgtaacagctttttgttttaagagtttttaaatttttttctaataaaatgaattacataaactattataataattacaatagtacaggatattactttaaatatttttccacctacattattagtttgagatttggctgaatctgtaccagctttattactcttattaataactactggtacaaatgaactattgtttctagttgatttttcatattttgaatctcttgtactgctggtgtttggagtagttttattcttattaattatatcttcatttttagacttagaaaaagaatttgatttaaaattactatttgtatttgatttatttgaatttccttttattgaagaattactaggtgttttaactgagctattagaactaggtttaattttatcattagattttcctttatttcccgaagaaaaggaacttgatttaaaattactatttgtacttttggttgttgaagaattactagatttaggaccaattgtagtactggatggctttgatgaacttttagtagaaaaagaacttgatttaaagccactgctcgaattagaccgactagagcttgatttaaagctactagaactggagctagaggaactacttctacttcctgaagaaaaagaacttgaagaaggtctagaagaaaaagagcttgacttaaaactactactatgcgatcctcctttagcatagattacatttatatttgaaaaaattatagcaaatgtacatataaagcatactatatatttcattaaattattatttttgttattcatgatatttcgatatttaatatatagcttatatacattaaatatcactttacactccctttcatttagttatatttaaattgattagtaaaattagtttttatattgaatatttaaaaattattaaaattaaaatactaaatagattagagtttaattacttttctgagaatagaatatttcggcaatcttatctacttcgcctccatcttcaatttgctcaaactcttccccatgtattgttgtgaagtaatataaaatatacttatcttcactatctaatacgttttctaatagaatatatttcttattgttttctaggaattgtatgattgctaatattttaaaatttatatcttctccggtagcgtcattggtcaatttgattattctatctttaaagatagttatattaaaagtatcatgatcacaattagatatacaagatccctctttacaccctaaacaagaattaaatttgcagtcttttacacagttaaagcaagagcattttaagcattcttctatctgtataaaattttttatatgcttttgtttaaatttttttaattcttctttatatttgctatcatctttaaagtattcaaataatcctttcccatcagcttttagatttgcttcatcgattaaatctaaatattcttttaatattttagaacttggataaaattttcttaattttagtttgtcttcttcaagcaaatcttttaaattgtctatgttaaacaatatatcggtatattgtttactgtatttttctttttctttagtagtaaattctataattttattcataaaactcatcctttctatgttatttaattaatagttatagtaatttttatatacaaatttctcaataataattctataaaaaaaggcactaattaccttattgaaaagctaaatagtgtctttttagattttaaaattagatttattatattctaatctagttttcttttagtttttgaatcaaatcaagtatttctagatataaccaaactaaagtaacaagtacaccaaatgctgaataccactccatgtatttaggtgctccataataagctaattcatttatactatctaaatcaacaattaaatttaatgcagcaatgactataactaataaactaaagattatacctataataccacctttatataaaggaatttttattccaaaggccaatgataatattaaagaaaatagatttaatattagaattcctacagtagctattatgatttcagttacaatttttttatttataggtccaattgatttataaataaccaaggaggatatagccattgctattgttaaaagaaccgctggtaaaacaattcctggataacttaaatctgtaaatttagaagcgattcctaagagtactccttctgttattgcatatattggagaggttatcggtgatactttaggtctaaaaatggtagtaaatgctaaaactatactaattgtaacacctataattaatataaatctaaggccggcactatcatcaatcattgtttgtgaaagactatctattttattccaagaaaatataaatgaaatagttagtaataacaacaatataaaggttttattatatgtgcctttaatagtcattgatttgtcttcatttaaaaatttacttttctttatacctttttctaagaagggatttggttttttattcattaaaatacctccgtaaagctttattgatatgaaatttgtgttctaaaaaatccttctaaatagaaggattttttaattaagatttgtatttttccaactcagcatcaagatctacttcattaagtttgtcaaattcatcatctaaacttacaggttttaaatcttctaatcctgctgcagttgtttcttttttgcttatttttctttctatatcatcaagattaatattatctgatgatacattgcatagtatttcatttactttttgactggcttcagcagtatttaacctagcattggcttcatctctatactgcctagtttctgatattgatttttctaagtctgctaatctgctttttaatttttcagcattttttttagcttctgcatgttttgactctaaatgcttatattgtttctcagcttcaattttcttttctaaagcttttttagctaattcttcatttcctatagataaagctttttttatttttgtttcataatcttccatttgagattttgcatcctgttttttttcttctaaaaaatgcacatttcctaatacttcagcagcagataatttagcattgtgtagatcctcttccatatttcttattttttgctctaatgattctattggattttctgctttatccaatgcattatttgcttttgctttaagcatgttattaatttttgagaaaactcccatgtttatcaattcctttcgtgtatgttttataataatatattatttcttttaaaataatttagtagaattaatatattaataatttatatataccttttttacaataaatttgcacaaataatttataatttcttatattgatctaataattctttattgtaagtatttttatcttttagcattattaatgaactattatttttactgtctttcttcatttgcttctctttttcttcattaattttaattacagaaatataatcatttaatattctataagtttcatttaattcaaagagtaattctttattaaatgaatcatgactataaattgaacttttatacacatccaataaatcaaaaatatgtttaaacaaaggttctttttctattaacaactcttttagggaaaatacaatttcatcaagtttatctaagctagatatttgtatatattttttgtttttaataattatatctgaaatgaatcttgctataattatttcatcatagaaattgcaaaaaggaattattatcaaagcattgaaacatgaagatgcaaaaagtaatacaaagtttaaccaatagtaattgccgttagtagtaataaataattctttaatagttaagccgaaaaaaaacaggtgaataatgatggcgataatatttccaattgcccggcatcgttgttttatttttctttctttttttattaaattttctttcagttcgcaaattatatttaagtctaatatctcatgtattattttattatattgttcaatttgataattattgtaactcatattaataccacctttctttaatatttcgcttcctcatttattagggtaattatttagggcaattattttatgttgttaggatagctttttaacattgttataatttatatatacctttattacaataaatttgcataaaaaataacatctatattctagaaattaataatagatgttatcttgagtcttagagttttaattattataatcgccttaagctaaatatctcaactggttgcatcataactataatggccagctatatctgaattaaataccatgaacgaaaatatagttgaacatataaagttcatattaatttgcatacttatcagttataatcttaattttttttgcaatagatttgaagctttttagtaatttattagtaggctcttcgtttgttaaatctagtagtatattaacctgatgattaatctcttgcatatcatattttgtattgttaggtatagacataatataatcacgctcctaataaataatctaaaaatatataagccagtacttcatttttagttaattctttataaacattaatatcaatttttacatttaaaataaataaaatagatttatctttttcaacactacaattaggaattaaactacgtaattccatagtggaaaaagaactccataatgaagaaagctcaattatataattattagttttatatttatttttttgtttagatatatctctaattttttcaatattatatattaataaatctgtattattaatatatttatttaatatattttcatatcttttagttcctttaagaatttgaaatacatctttagctattgtttcagaatctatttgggaaagcaattcttttacagtaatgctttctttatttcttttttttgttttaaatgcagagaataaatttattggtataataactggaagaaaaataatatataatattgctgatagaaataatcgagaaaatgaaggaaacataaaaaaacccctttcttttatatacaataatattaatcataaagtttatttaaacttttaaatattatatatacattttttattaaaaatattagcaacattattttttataaaaaataaaaagagaagaagctaaaaataatattactcttagttttttctcttccttagatagatttatttaacaagatgctaaaaaaaatatggttaataaaacaaatgccacacaacctaaaatcgctacatacttttctgttttgtctgattttattttatcatcaactttttttattaattgctgctccataactgaatctttttctgccataacaacaggttcatattctatcattcctactacaacttgtattcttattttacccttacccaagtcacctagttttaatggttcctttacagctttatttaatatcaaacttgaatattctccgtctttaccctttattgctgtagcttcttcaattgatgttatttctctatcaatttttttattactatctactaggattggcattggcataattacatttgtatttgcttttactggtcttatgttagtaaaacataaaagtattaaaaaaaagaaaactcttttgcaattagacttagataacatacaatatccctctctttattggtaaatgtaactatagtttattatcaacttttatattttatttgtagaaactcatctttaagatctaatattttcttatcatctatttccgtaggattctttatttcttgtaaaactgttcttccttcaacattttttaatcttgtctttatatcttcacatttagtataaagtttatcaattatataggtttctttttcatctagtttcttacttttcttatagtttactatatcttcctgtaattctataacactatcataatttttagaatcaacttttaaagggctatttaatagtacagttgtacttactatcattagtattatcaatatactcactactaatataattctatcctttgaattcatgagcacatacactcctttaatactgcaaaatctaatagtgatacaactatgctgatacaaagttctttagacatataatgcacttcctttatataaactttatttaataatacattaaaataaaaactttattcatttagtatgctatgaacaataaggactaccataaaaactaaaatctctatttttcataacttattttatataaaattcagccatatcatcaagtcttatacaagcaactttgccattagctttttcaaatacacaaccacaatcaatatatatagtcccatatcttttaagtattctaacatcatcataattatttgttattgattgtactggagtatgaccacatattactgtataatctctatatttttgttctttacctatattttctctattccataagcaagtatcttcatcttgatattttataaaatcatctatacttaaataattacaattatcaggaaaactcagcccagcatggacaagtataaatttatttatagttttaatataaggtaattttttaaagtaattatataaagatttatcgtatccaatctctttatttactatttgagaatgcgtaatttctcccccattgtaataccataaacttatatcattattttcataaaaatctatatacatttgttcatgattacctttaagcaaagtaatatttttatgcaatattatataatctaatatttccaaaggattttttcctctatctaaaatatcacctaatatatacaattcattatcatttttaaattctatctgatctaacatcttaatgaatttattatagcaaccatgtaaatcactcataacgtatttactcaatttctcacttccttatgatatcccgtgtacacttacacaaaatacttattattatccttttaagtacagtagattaactgctttttgccattgaatggatttacattctgcaacttttaagtttttttcatttacaatagttttagatagtttccaattatttttagctacttttaattcttcttctgctttatttaattcttttaaaaattcataatataacttactgttcatttttccctccttaaagaaaatactaagatacaaatctttatttcttaatatttaacagcttttccctttgtttctgcacctattaaagcataatatccagacttattagattcataaaatttcattgcaattcctctctttcattttaaatactattgttataatttatatatacttttcttacaataaatttgcataaaaaaataacacctatattttagaatttaataatagatgttatcttgaattttagagttttaattactataatctccttaaattaaatatatcaactggtttgcatcatacctataatggccagctatatctgaactaaataccataagtgaaagtatagctgaacatataaagttcatattataactacatagtgtttctattctaataaataatctaagaatatataagccagtactttatttttagttaattctttataaacatcaatatcaatttttacatttagaataaatagaatagatttatcttcactttcaccataataaggtagtaaacggcataacgctataggagaaaatgaataccactctgaaagtgtaattatgtgattattagtgttatgtgtattttcctgtttagatatatctttaatattttggatattattcattaataaatctggattatttatgaatttatttaatggattttcatatagcttatattttctatcttcttttaatatttttaaaatatctttagctattatttcagaatctatttgggaaagcaattcttttacagtgatactttttttattccttttttttattttaaatccacaaaataaattcatgggtatagtaattggaaaaagaataatattcaatattactaatatgaaaaattgaaaaggtgaatacaacatttttaaggctcctttcaaagataatattatataaattttatatatacattttttatagaaagtaaacaaccttaaaactgtatttcttagatatattagcaactttaattttatctttattttaaacttgtatataaacaaaataatttattgaattgatatgtaaatgaagtatctattttgatactccattattttatttgaatatatgatactaactatgaaatagattaattaatcctggcaatgcatttggtataaatattaatattattgctaaaataaacaaacaaacagatctaatgctaatgctatagcaacaagcacagccaaaattatcataccatatttaagtgttttggctgattctatattatcattaatcctctgttctttatcattaactttctgtttttattgctgctccataactgaatctttttctgccataacaacaggttcatcttttatcattcctactgtaacctttattcttacttctccttttcccaaatttcctaatttcaatggctctcttacagatttatttaatactaaatttgagtatcttccatcattgctttttataactgtagcgtcttctaatgatgtaatatctctgtcaatttctttactactatccattattggcattggtattggcattggcattggagtagttgcatttgcttttactgttcttatgttagtaaaaaataaaagtattaaaaaaaataaaatccttttacagttagataattttttaaatttaaacatcatatttttatctcctatcttatctgtatcgctaattatttgaattacgtttagaattcttttacccacattctttttgaagcgtaatatattcttccatttttacataacacttgtatatatatttcacctcctgtaactctatattcctttaaaaatgttctgactacatttggtataaatatttctaaggagttaccctttataaaacattgtttattccctccaatatttgtattgtgaattatttaggttcttctgggattactatttttgtaaaatgtgtaacataatcaggaaaattacaatctaaaggtgagccgcaatatggaggttcttctataggaaaactccaccacaagcaatctccataatcttcaccccattcttcaataggtcttggttcatttgaatttcccaatttctcctcataatactttagataatttcttacctctccaaatccaactaatgcccaatacattatacatgtgaatctatcatcatccatatagtctccaaaatctaaagcattacaataactatcattatgctctataccatataattctttatccatttttcttatatattcaactaaagatatatctttatctaagaatcttacaaatatttcatcgtttttcccaaatacaaagttatgcatcctttcaatcatgtcttgtggattttcagttataatctttttcatattacttttcctctttcataataatttcatttctggctcttatctttgaattacgaattaatcttcaatgttgttatagttattttcatttccaactatcaatgtgtaatcttgccattcttcatagcagttacactctactgtattagtttctccaattggtttacagtcacactttgtcatttcatcaacaatttcttcttcattcatttcaagaagttgttgtccagtatatgttgattttattactctttcggttacattgcttttaagtattatctcaatcataataatcctccaatatttgaattgtgactattcctcattctcttctattccaaaatcaaaatattctaatacaagttctgttaaagctttttctgcctcttctctagtttcatattcatctaaatacacaatagttccatttgcatttaaactacaatttacagctcttaaaacctttcttttactcatacaatagcctcctcatctttggattgcgtcttaacttataaccttaaaattttgttcaaatatttcttttggtagttctaaccatgataaattatctttttcagcacttgttagcctgatctcaccaccaataattctaaaactatcatcttctatgttccaaatagaatctttctctataaatacattttcattttctattgaaaagccatcatcatcacacttttctactaaaaaagtttcaatacatttagctttcattataatccctccaatctttgaattgtgacactatttatttatctttacttaaaataatcataccttcttgaatagattttatataaacaggtggattttcattaatcttttgtccttcttttaaatctataccatttaatttatctataaattctttattatctactggtacgattcctgatataataggatgttcaaaaaaatattccatattcctatagttcctcctaattatttaaacatttttctttctaaaaacatctaaatatttttctcctaatctatctatttcttttttatatttagttccttctgctaatgccccacataaattcattaattttgcttctgcttcctgaagtttaaaatcatctaattccgtttcaacttctgcacaagccattaatactgttttagtcttatctttcttcatgttaaacctcctcatgttttactttaatttcattcatagatctaatgtttgaattgcgaacatattatgtctaattcattcttacaatatttacaaacagtagtataatcattttcattataatttttttaaatattaaatacccaatttatatatcgtaatataaatttccccattgtaataaaaaaccagctaaaactattccaatagctatacgctttaattagtatcacttaaatagtatagtaataaattttgatgctattacaatgccaaatgcacctaaagttatcccaagaaaatcaagcaacaattcctgcttccaattccaattactttctttttccactaatacaacaaaaaaaattacaattaaaaatgtaactatcattaacactttatttttgcttaacatattatacctccaaattacacttctttttatataacctaatacgtaaaatagacatttatttcgctccttcgtatgaatttcatttatgaatcttatatttgttatttatacttctagtaataaaattaagctataccaatatttaaacattgtagacatataaacaaggcatccggctatttacttttaggtgaagtgtatttgatatgccttcataaatatcaagaatatgcaagcacataatagtgtccttgatatttatgagcatatcaaatagtaagttattaatggtaagttgaccaaatgcaatcataacagctccattttcccttacatatctttccccctccaattacgatgaaactgaaattattaagttctaaatatataagacgtcagaattccatttttattcttgatactaagtttagctacccatttgcaccaactccaagagaattcagttttcttttttactaattttgctcttttagcaattcccttttgatatttattcaaataactccctccaatctttgaagtgctaactataaacaactgtaattaatttctttttgacgtgtatttctgctttcataattaggacagttaaaattacacatagaattgcactttctacattctgcttctacacaaccaaaatttatacatatattattttcatcaatatcaaacatataaaatcctccctcctataaatttcaatcctggatataatcctcaacttcagtattttttatagtttttccaaacataattgaatttctttctaatttatagtaattttaattcctataactttttttgtattgtaatatactagccagatatctttaaagtattttttattttgcatttcaagaattcaaatttactccaaaatatataataattagtatctgcgaagtcagtatatgaatacacataagagtataaatattcctgctcttttaatatagaaatcagcttgtcttcaataaaatcattagtgaatctcacctcgtcatatttattgatgttgaagccttcacatagttttttcacttgttcatacatttcaaaaaacatacgttcataaccttttaccatttcctgcttgattttcttttcaatactttcaagaaaaatatatttattgtcattgaatattttgtttgctataggtattaatttatttttaaaataaaattcttcatcttttttaattatttcagcttctttctttaatgttgcaatatttttcacaatcgccctccttttttattaattaattaggttataataattacaatttttttcagctatttaataatgataaatattctcctattgacataggatttgcttttataaattgtttcaatttgtccaattcttcttctttgataacatagtataatttaccgcaatgctcaaatgtacataaaggactaatttttgaattatgcaatccagtattttttaaatagtaacagctccaatccagatctttcttattaactattttacaaccatttctacacaacactacatatcctttaggtaaacttaactcttttaaatgaatattacgttttattgctaattgataattcccattattaaattcagttattgcttttttatcttttttaatttttatattttcatatatttgttcataaatatttgacagtataaaggttactgaaccactaagaattatataaaattctagatttagatgcttaaaatatgatacataaaataaaaagatcaatgaaacaatgcagccaaaatagtattcctcaaagaatataaataagtttacaaagattaaagcaattattatccagatatataagtttgatgaaaataataccaatccatttattactataattaaaaccaatgaaataataacttctgtactggaaaccatataattcaccttcttttgttattaatagtcactatattctacattttataaagcaatacatagcctggatctttttttataagggaaattattttataattacatgggttaatatctttttctataaataaaaatgatctattcgatacatattatttacctccacttcgattaagttatgatattttcatttttggatttgctttatttgtattatgtattttctaatttttctataattttttttataacttctgcggggtacatttcacataaaattctagcatatgcttgacatgctcttctttctatttcctctatctttacatctttagggaactttataattacattttttatttctgcaccttttgccacaagcgataccacctttctataaattttatagataaaagttctgtttctatccatattctcaatataatttaaagaattaataaatacaataatactatggctctatttatattagacatatagcaatatttttcaaaataaaaaacacgatatattattttaatataccgtgttaaaaaaaattattattgattataatgaaattttcaaattattattttattcttttgcttatttcatttaaatcattatatatgtcccttagttcgctaagttcatcatttattatattatcttctatataataaggttgtatagttacaaaaccattcctcatgatatatttgtataatgagaatttctcagttttaaaatcataaaaccgactttctattttgccatcttttattatgtaattatctaatctcaaagaattgaatatatcttttttatatctatcagtattgatagaaactgaaaatatatgttcattttcatatatttcattcatcataagagtagtatgaccacacatagaaaacaaaaccaagttatctatatttccaaagtcttgtacatttattaaaccatattcatcattcaataaatatgaaaagaattcttcccttgatgttccataattaataactattactccaatattaatgtctttatcgttacgtgtttcaaatttcttctttatatttcttatgtttctatttgtttgcctgtagctactgcttatttcaacaattccatttgtcttataatcaataaaatcttctaagttactattagggaaataagctttccctaatatatcaccatctttaagatttatatcttttagtattttagcatcttttgaaaaaggatcacaatctaatgtttttacttcaaaatttaatttagttttatcttttaaaacaaatgtgtattcatatttcttattatttgaaccatttggctcatagtctagatgatctataattttatataattcactcttaaaataaattccacaaaagatgtaaaaaaatactgaaaattcacttaaattttcattcaaacttttataattgaaaacaccttt

SEQ ID NO: 69 - DNA, 68459 bp, Clostridium botulinum
tttattaaattcatctttggctatactaagacctaattttattagttctttttgagtatagcgaatatcaatattattaagctgacataacaaacagagtagggatatccccaatctcttattaccatctagcatacaatgattgttgatcactgaatagcttaagacagcaattttttctatatcatctttgtataaatccattccagcaaaagtttgaaatggattttctaaggcacttttaagaagttctttgtctcttactccatgacttcctcctgttctattgacaattttcctatgaagtgttaaaacttcatccattgaaaatactagcattttgctaattcctccaatgcttttagattgtcttcgagaaaacaatccattaacttttctttatttttatgtcctttattttgtttgttttgtaatgcaactttgagcaaactcctgcgatttttcaccgtatttgtattttcataattctttaataatctcattctagttcccccttaaattttagttaagttatattaaccatgggatattatctaattaattattattgcaaataaaaaacatagtatattaaaaaacatactatgttgaaaaacttactattagttgtaagtattatatttttactatttaattttgtagtttttagatatctagggtcttattttaatttttttatatttagctactgcttttattgaatttataacaaagtattataaaataaaaaacacagtatattttttaaatatactgtgttaagaaaatttattattttatcttaacttatactgaattggaactatgaaagtatatatttccttttttatacctctacctttatattctgtttttattttaaccattggctgctctatatcctttttaataatagtatattcaacttctggcttacaataaagaacagattgtctatgtgtaaattctctaactttttctattttaccatccataaaaaaactcacataaatttcgctactattttgttctgtaacagtttctatttttacatcttctatttttttattaacttctactatttttgaattgctacaacctgtaaaaagcaataaggttatcaaaatcacaaaaaattttttcatattatatctcctaacgattattttttatttaattctcatcattttcaaaactctcgtaattcttttgagaatactatggtttttattactccatttttataaacagttataactatcctccattaaactttttaaaattctaatattatattcttctttcaaatctcctaactctttttggagatcttgcacatcgtttttaagcttgtttatgtttatataatctctattacagttcgctatatctaaacccatttctagatcagctatgtccatataaattgcttctattttgctagataatttcatatctagatcaaatattttataactaacctcctggattagttttttttctaataaactttttaaatccactgtgcgagaaaaaaagacattctgaaaatctcttgtattagagaaaaaattaatctctccatctttataaattaagtaatctcctgtttgagggtgtggtacaccaagggtagattgataagttcctaagcctggcatttcatcatacattaactctgaaatatatggttccagatcttgatctaagtcttttactattttaaagtaatgattattcccatcatttaatttttcaaatttgtttttcatttctaattcccccttaaattttagctattattggccatatattctatttgattaattattatttcaaaacaaaaaacatagtattaaaaacatactatgttaaaaaatttaatattaattgtaagttgtttcttagacctgttttatttgtatagtcaactactcttctaagtatttatttcctatctcacattcatcaatgttaggctttatagtcttacatatttcatataaagcacttaaataatcacttctatcattgaaatatatagcattatttgctattgcaaaagccttatcaaacctttctgaaatcgtcactcgctctacttctactatgtgcataccatatcgtattgaactttctagtaatctatcatcttgtttacttaaccactcttcggcttcacttttatctgtaaaacttgtaaaaatccctttttcttctttatccataatgtcataatatttcacattaattcacctcattttacttcataataatttcaattatggaactaatctttgaattacgaagtaaaattacattctgtcaaaatcaaaattattttcattacacagtttttctaattgctctatatccactatatcataatcacttattgaataagtatcaccaattggatgactatcatgtttatcatgatagtgaatataaaatatcccttcttcttctaataatagtaattcaactttatctactccatatttattaatggcattattcatttctgtaactatctcagttataaacttatacggtttcgcttcttcaattttactcatatttaaaacaccttttcttttgcaataattcgcatttatttaaaattacttactatatttttggattacgaactaattccattgagacatttaaccacttgtgtataatagaactataatcaaagcattaatatttatcccattctaataggtgcaatcttttatcgttattaatatattctgttgctttctcctttgaaccaaactctaaatatttaaaaaataaaccgtctattatacttcctattaaaagaaattctccatctttttcagcttcaatattccatttcattcgcttgttaaatattggtcttgctaataatttgtttttttctatataattttcacattggttcaattgatgccttaaaaccttatgctttttacagaatataaacttagtaatatttgagctaccgtcactgtatttacattttttacaaaagccctttaacattctttggtctcctccgtttaatacgcatttttttcaatttgtaaattaaacattatgatagatttttataaattctccttttcttgtgaatttataagtagtattgcatacatgaatatatttgtattggccacaatcaccccaactatattcttgatgattacaattaaacatatttatcatatatttataatccattctatttatatacctcctggtacgtcatattaatttcatctaaaaatatatcttcttatttttcccaagtggaaatcttctatagtaacatttcccttttttttcttcccgctgaatactcttaaaaagatttttaagttcttctaatttatcttcataacaatcttttctaaagtaatctttattatttactctaaactcaactctatatttatttattttatatccctccatatttgtattacgaattatccttcttcttgacttttatcacaattttctacagatagttctgattttgttaaatcatatattctgtcaagtaaatccattgaaaaatcaaatatttggctataagtactatagcttatcttacccacagaattaagaccatttaggaaatctgccatttctgactttattttttctttaggggtagctgtttctgagattccccaatttcccatgtaattcactcctccacattaattttaagttcaattattgcatattttacaacagctgtttaaatgtcgtatcaatagccatatttatttttacgccattcacttgcttcttctgcacaatcctcatgcattaattcgcaccaatcttcatcattttcggaattacatacaccatcgtgataaacttcatcattatctatatccttttttgatataactttatggcaccaaggacattccacctcatctttatccgtatcaattaatttccctgataaatttttatatttcatctttatacaacttccttcctatttttttagcttacataagccatatattctatttgattaattattatttcaaaataaaaaaataagcatctgatagtctattaaaaccatcaaatacttatttttaaaacatatatttaattttcttatattattatttaccaagttcttttaatgcttcttcattattatctataaaatcatccattaatttttctttatcttttttttctttatatttaataaactctatatattctattacttgcatctgctgctgctgtgatagacctttaacattttgaaatatcttttctgctaatagcataacgatcccttctctcttattgctgttatttatatatatattactatcatcactaatttttgtaaaggagtagttaatattcatttaattccaaatacacaaatcatgaaagtattttatatctatatatttatatgcctatcttttgttaggattttaaatttataccctattaatacaataaatagaatcccatatatacaagttcattctccctattcttctgaccattctttttttacttcttttatatattcttctctaaacttaatatcttttaaaccatgttccatattaagaagagtcagtacttcatgttctgccctaaactgttttttagattcttctcttaattcttcatctaattcataaacagattctaaagcaagaattgacatataaagacgattgctaaactcaaagaaccagtaatttggtaagtcaaatttaagagaatcaaactttcttagtaactgtttatataaagtatcatttttagatattccttttaatataagtatatactctgattttatatcagatattatttgttctgctttcaaatagtttttctcgaaatatttacttttctttttcaatcttgcacttttaaaatccatggtatccattattattctccttataaatagattatatatttctatatcataaatattctatacttatatgtatttgaccttttcagatttattataaaatatgaaaaacctgctaatataccagcaggtccttctataaatacaaattagaatcctatattataatgagtttcagcacccttaaatccgatatcattagttaatttttcattatggtgcaaattagtagcattgaacccattaacaggtaccttaatttcagctttacatggtatctgtactaattttcttattgtttgctttgtacctctctcttcatctaaagtataagttctagaaacataggcttcagcaataaagttaatagttaggagcggattatcaccggcataatcaaatttaaatatacatgttcctccattttggtctagtttgcaataatatggagaagtataatgtgttccatgaccaccaaacctatccaagctatgatttactgaccatttttttatagtggctcttactccatcaatatacacaggacttaaagatatatccatagtatactctgtttctttacctttttcgtccaaatgatatctggtgaatgggaatttagcatcagtatttattatcatatgtgctgatccgccactgcttcccccactaccattgctacccatgttaggggtaaatcctgttgttttatattcccatctataacgctttacttgtctttctttttgaacacgtcttgttttttttgttgttgtttttatttttaccaaaacagcatattgtaaatattcatgcggacctccggaggaatcaggtgcaggagagtgatttactgttttttcttgtacaatattataaccagcaaattgatttccaacttgttctcgtgctgaatccgtaaaacttttattgggatttataggaactgctataacatcactatagagccatttaacagtataatcttctacagtatagttctcagtagtccaatatttctcagtagtccaataacctactctttccatatggcttgtatctatataaggcggttgtttattactatttttataatcataaacacttgcagcagatacaagacttgattgaattattaatatgataaaggatagtataatgcttaataatctatttcctttcatattttcacttccttacatagttttatataattattatttcaaaaaaataaaaacaactattttggcttttaatagttgtttttattttaatattttatttaactatacaatatttaaatatatcataagaagatgaattatcattagaaaatgttatcataactaacatattttttgggaaatcagcaggataaaaattagcattagattcttttccatgttccattcttatatcactcatatctataacacaagaattaaaacaattataatatttaccattatctaattttaagccattgtcatcagcaaatataacttttgcatataatgcagattttgtttttcctgcaacggtaatctttgtagaaaaaggcttttggtaatcaattaaagtatatgcattatcagatgttctcattaaaatagcatttttaactaatttatccgtccatacacgatttggatcattgtaattattagtttgaatgccttctctaccaagtgatttatcaaagaaatctaatctttttcctcccatccaaggcgctccattgccatatgggttaccagtaaaatcacccttccaaatagtcacttccttaccattgatgttttgtatttcttttttatatccactggttaactttttctgctcctcaggcatatatttaggattaagagaaggatcttttatatattgcactttttgattaataacttgtacataaggtttaatttgacttgtatacttatctaagtccatttttcccattatatcaaaatttaatttacgtgaactaatactatttccaataccaagtaatattacaactaaaataagtccttttaattttttcttaaccatatgtcactcctttccatcctaaaatctgatatattttaaaataacactgctattttttgaatatcttttattttatcattttctttagatattttaactaaagtatttttaggataatactttgctgaataatctgttgcaccttcatacaactctactggactttcaaatgataaactaatattatcttttttaatattaaagtattgaccattatctaatttgataccattctcatccgctgatacaactttagcataagtcatgcttagtttaacatttggatctatttcattatttgtaatagtaaacggctttttataatctataaaaatatatttatatttatcgcccattttttgtttaaatgcatacacatccttaaaaaccttttgatttttagctgttaggaattgcacatttaggtccatgttttctttgctacttatagtttctttacctggagaaattattgtttcagttacaaacccttctttatgggctacttctaatattttttcattattaacatgaattactgttttatctttagtataatcaaccttagcatttcctttataaacagttatatcacttttatatattttttgtatttctttgctaggcttttcattctctttattctcctctactttttcttgtgtattttgaacagcttttgtatccttggatttattaagacccaccgctattccacctactataactacacaagcaataattattgctgttatcttctttttattcatataaactacctccaaattatgtctctatctatatattatttctatttttagcaatctttatatttatatattaaattaaaagcattatttatacaacaaaaaaacaaatatccattatagatatttgcttttttactaatttaatttttatcatgaataaatatactttatataagcaaattatgttgtttacatatctctttagataaagtttttattccggttttaaataaaacaatgatattatcacctttaatttcttggattttaccttctccaaactttttatgatatatgtttttgcttattatatcattgcttttatcattattatctttattcttatttattttttgtaattcatatataaaaacagaaggatctttttcattatataggatatataaattagctttagctctagtacatcctacatataatagtcttcttgttgattcaatcatttcatttactgcttctgtaggtattttctcctctttttgtttattaaaagtatcaaaaatgttattattaatatctgtaataataacatttgaccattctaggccctttgatgaatgtattgtatttaaagtaatgtttgcatcttcatcattttcttgaagaataacattatctatctcctttattctaataatgaattcatttattgtattagtagttttagctatatatttaatgatatcaactatctgagaatcagattttttatcattatttaaatactctttatattctaaaatattaaatataaagcttataattttagcaggattagtatgctttgcgagttgctcaaaatcaaaacaaatatcattaattttttctaacatatattccggtatgtctaaactagaatggtatcttctcatatagtcaaaaatgttaagatcattactaaattcattgtattgtttacatactttatttagcattgatttacttatatatataggctttattttataaactatctgcaaatataattcagcattgttcatattttgactaaaataatagattcttaatatgtcttttataattttatttgttgataaagaaggaaatttagcttttatattgatatggatattatgattaatacaataattaatcataggtattgcagacatattatttctatataagatccctatattgccatttaaatttggaattaatttttcaaatattgttttattggagctctcaaaatctgtaaagtttcgtaattctatacttccttctgcatcgttagaggcaatcatttttttattgaatctttctttatttttattaataaatatctcattgtatttgactaaatttttataacttctaaaattttggtccatatatattacttgagtatttttatattgtttaggcaaatttaacaataacttagggtcacttccttgaaactcatagatagtttggtcatcatctccgaaaaatgctaaattatatttgtccttatttaatttttcaattattttgtattgtaacgggctacaatcttgagcttcatctatttgcatgtattcaaatttattaacatatattgattgaatttctttatttgcggctaatagattattagctatgattaacatatcatcaaaatctatataattatatgttttttgagttttataataattgttatatatatcaatgaaatctgtaggtaaatcaaatagttctattttagttttagatttttccattacttgctgtgggtatataaaattgtttttacacaatgatatcttattagaatatagttctagttcatcttctgaaatttgttctttattatgttcaaaatagattttagaaattatagttttcttattaataggatctttataattttcaatcattttgtatttaatattattcattttaaaatatgttctactaattaaataacataatgagtgaatagttgaaaaatgaggactatatttaattgaatcaccaaagattgtattaaatctatttttcatttctaatgctgcagctttactaaatgaaatgcaagaaattaaattgggatttatatttctaactaatattaaatatccaattcttataatactggataatgttttaccagaaccaggaacacttataactagcaccactccttcagaagttgtaacagctttcttttgtttgtcagttagttttatttgttttgtttgtattaattcgaaaaaatctcgatctgtcatctttccattttccctttcttcttgatatatttaataagttcttcccctggttgtacatttctatttaaatctaagttaatcttttctttagcctttaacttatcgtatttttctttctttaatactgttgtataattgaatgatattttaaataattttactatttttactgtttgtgttattataatttttttattaaataaatacaattcattgaatacaataattagcacattgctaattttctttgcatatttaattgtacaatctaaacatttaataatgaaattaatgtatatatctggcatagtatcgcccctttcaacataataagcagagaacataatcactatattctctgcttaaaaacccgttcactttaaacttctctttaattaatttgttattcctcaatattagccatatattttgaaacattactatacttctaataataattcgtaacatcaaaaagtacactttaaatcaaatatattacatcctcaaaatttgaataagataaatctatctatatataattattatacatttattaaaaaatttattaaaaaatacaaaaaaagtttcaaaaattagtacgataatatttatatgagataataaatatatgtaaagttaatatggcaaattgctaaaaccccctaaatcccccttttcaaaataaaaagtttaaaagaaattttaaactttttatttttttatattcaatatttcttatatctaatatctccattagtggttccattactattaatcttccataagccttttttagcacttctatcttctctttcacaatttgtaaatgtatcaacgtattttacatttggagggaatgtactttgttgaccaaatccatttgataataacatagaattaaacattttagaatttatttcttgatcactattgctttcaggtatctctagccaaacatatcttagcaatctgccatatttatcagtattacttatgtctttttctaaatatacagttttatcttctaacatagatcttgtatataaagtagcttctcttccaaagtcctcatgcttagtagtgtcttcaggacagttaaccccaatgaatctaaccctttccccagtatttaaaattatagtgtctccatctataactctatatacagttgctttttttaaacttagattattttttccaggataattattacctttaatattatttattatggaaacattatccctcacaacatcttggcttaatttagtagcttcattaatattttgacagcctgtaagcaaaacagttattaaaataataggaataaattttttgatccccataaaattatcacctcttttatcagaacattttaataaaatggcctaatgcacttaaatatatttctttagctacagtttatttcaatcatagttttagttgttgaattcaaaacttttcccttgatttatattttaaacaaggaaatcattttaatttaaaacgataaagtattttacaatttattccctaatatattatcaataagtagacgatattgatcattcttttggtttaacaatttttctacagaatctccatttatccaaatatattttatataattgctatcatcaataatctcaataacatattccccttttacgaatatggatttacaattctcttttaattttactatgttataatattgctttcttttcttcgaaaaatcatcttttaatattatttctcttttaggttcacaatcatttgctttatttataagtatacttttatcttcaataatattaatcatctttaaaatctcctttataacattatttaattaattattatttcattattcaaaaatagtacagttctacaggaatggctataagcgttgatttaactagcattgcgctatatccaaatctaaaggacaagtttcgcgaaatcagcatttcgcgaacttatctaaaaaattaagataatagtatatattttgatcaaattttaattgaattgcttcaacatcatatgaaagttttttaaaataagaaataaatccttgtgggttgcatggaatatctataaaaaaatgtgcataacataattaataagtgtttagattgattatataagatatatattgtacataaaaactaaatgagatgaatttaaagtataaaataaaaaatatcaatctagataagttgatggattttatagagaattgattcattttatggtaatatttaataataaagtaaaatttctttaagaggtctaaataaataatgagtatagagagatatgtattcaagaaaaaatttgtaaatttaaaatataaatatgggaacagacacttttggtgtacagaattctatgttaatatagttagacgcaataaaaaagttattgaagagtaaaaaaatcaacagaaagaagacatgatgtcagagcaaataagtataaaaggatatatacatatttttctaagagcagcaagtaacaaaagatgtagctggaagaacaaaaagcgccttaaagcttaatgctagtaaaatgtccttatacgatgataaaaatacaatcagctaaattgataaattcttattattactatatagttaaaaaagtatgggaaaaatttaggaggaatgtatatgttaaagggaatagatgtatcagagcaacaaggggaaattgactggaaggctgtaaaaaacagtggaatacaatttgctattttaagagctggctatggtaaaaataatatagataaacaatttataaataatgcaaatggatgtacgagtgtgggaatgccatttggactatattggtttagttatgcttatacagaggatatggcaagaaaagaagcacaatattgcatagctcaagcaacaaagtataaaataagttatcctatttgttatgatcttgagtatgacaccataagatatgctaataactgcggagtaactattacaaaatctttggctactaaaatggtccatgaattttgccaagaagtagaaagaaacggatatttttcaatgaattattctaatcaagattttttattaaataaatttgatagcagtttattaaagagatatgcattgtggtatgcttggtataataatagtttaaacagaaagtgtggtatatggcaatatagtgaaaatggaagagtaccaggaatagctggggcagctgtagatatgaactactgctatttaaacatggcagaagggcctaatacaaagctaaataataatacatccacacgagatcattatctaataagagaactccaacaagaaataaactcccaaggatttggagaagttgtagttaatggaatagcaggacaggcaactattaatagtgcgccaatttgtaagcaaggtgagagaggtggaataacaaaagttatacaacagatgcttataaacataggatatccagttggaagtcatggagcagatggagtctttggtgatgatacagtaacggcaataaaagcatttcaaagagattgccacttagtagtagatggaattgtaggaaaagaaacatgggaagcattatttagaaatttaaaataaatatcaaaaagaaggtagttccttaattggagctaacttctctttttattttgaaaagtataaatattatcttataattttcttattcaataaagaaaggaactcaaaatcaatgaatcccatatacatagaattttctatgtatatcggtttagtgttttagcttatttttattatattcaaaacatggatattgtagtaccaaaacacaatatatgttttgaggaaaaactatagagggtataagatttgatgggtacccacaggcttgtgggagtcctagaggtgaagtgatgacagaagaataggcattagaagtttggtagggaattttaaaaataggtcaaataggaatattaaaaaaagaaattataaaattaagaaacgaagcttggaaaaacaggaagatatcttccaaagaaggtcaaatctataagattatagaagaaaaagaaaagcaaataacacataaattatgcccttagaggttcacgaatagtgagctacaactaggagtatgtccacccaatcacctttgtacttgccttgaaggtatgtgcaggtacaaaggtggttgggattagtcacaaatacactacgccgacgggtaccctaaaaaagacttgaaggacttagataaacttagtctataagtggcttgaaggcgtaaaattatgtatattagtaataactctatggagttaagttataaaaattaaaataacaaatgcgacataaatagaaaaattgttttttaagggcggagtggggggtttttaggaatggaaaaagaaagataaaataaataaaaagattaatctatgtaagaagtatgcccttgtaaaaaagtttaactaaaacatataataaagtttaatcattcgtgtttttattcatattagcataggtacattaatttaaacaatgaagcacttctattatttaataatattacgaaatataaaattaattttacaattttaaagctttattttaattgatttttttacaaagttataagaagataaagaatgaaaaatctttaaaatatcgaaaaacacattaagatttaaggaggaaattaaaaagcataaggttatagaaccttatgcttaagaaatattttaaacatatcattataaaagataattggagatttaaaatgataatatataattaagtattttgtacttgtaaagttcctcctaattgaagaggtccagctaaagctacataattaagattaaagatatcactagaattccatatgatttcagaaactgaattttctaatgataaatctatacttggggctgtattaatattatagttttcaataaaattaggaataagagttacacttcctactaatgtaccacctattaaagcaactgctaaaaatgatccaatacctggtacaagttctaatacaaaacctaatgttgcaattaaaagcccttttatgatttcaaaagctacatcctgtgttttttcagtatattgtttattgattggagaaccaatttgttcatatgctatagtttgttctcctctatcatttttacctaatttaaatctatattcgcaaatagtttcacaaattgaagaaactcctactggtagatcaactcttgtagtagattcaagtcttagataatttcctaataaagatactttcaactcttgaatataaggtgtacaagtataaccacaagcgtttatgttatctaaattaattttcttaccttcttttaattttaatatataactatatcctcctccttggttactttgattaattacttcgaattcatctcccttagatttaggaaatttctttgggatagttggaagtaatatattttttaataatctgtcttcagaaattagaaaacctgattgagaggtttggggaatagcattaggatcaatcttttgctgttgaatttttgaaccttttctaccatcagtcatacataatactcctaaagcgcttttagatagatctccatctatttctgaataagcataatctacataacttggcttagtccatttccatttctcattattagatatatataaatttaaattaactgtattaaaaacgtagttgaaaaagtataaatttctttctaaccattctttaattaatctatgaaaataattcataataagctgatcatcttcagtcattaataaacttctaacatctttgttaaaataaaatcctttaacatcttcgcttgttggaataattataatagctggatcttctgcattatttgattttgttcttatttttaaatctactaattcttcatttttatttttactttgaggaaagtggggtaaatatttaagttttacttgaatctctaaatttgcagattcaaagcctcctgtaccgcgtgcatatttgcctataatattagctttaaaatttttaactggaattttaagcctaatatttcctccatctcccccacttataatttgccattcttggaaactacctttacaatctccatatttaccatctaaaagttcaaattgttcaggtgtaggatgtttaaatttaatggcttcattaacaatatctattggaactgcatatacggtatcccaatttaaagttgttgtttgcattagtttcagttcctccttagatcaaatatttttatattttatttgttgttaggtttattgtttttttctaatgttccacctaataaataaattccttgaagtttaccaaatgttaccttaagctcactatctttatcaggccattgcatagcaccaatacattgttgcataaatgcattaattcccggtatagctgtataatcattattttcaatagcattaatatagtctataagaatttgaccaaaactcgatcctaaagttattgcagtaatcattgaaacggtactagctaacttcttaagacctatagcaattctttgaccaattgacattggtttacttttcatatctgctaaaatttgtatactagtggttccattatttgacataagtctagcatcttcagcagcaatgctagaatttcttctacttattctttcaagttctatatcagttactcctgaatcctttcttagttgtcttatatttgatctattaagagtaattttctttctacctttaattgttgttgcttttgaacgtataagtttataacccttagataatgcagaaccagctaacttcagacctgctcctattataatactaaagacagcgcctgttacagctgaaactatcatgttttcataagttttccattgagcttcttctacataatattctattttaggttcatcatgaactttaagtattggaatttgttttccagattttaattctaatgccaattcatattcttgatgaaaatcaaaatgacctgttacacctcttccttgttcccatgttaagtcaagcaattctaaaacaattaaattattttgaagtgataatttcaatttttcaggcttaaggtatgaatcaacatttttgccatcagaattttccactttcccgaatattatttgtttattattagtaatagttagagtgtttatgtcagctactatatcatctacagaaataaactgtgaacttaataatgcttgttttaaaaaatgttccataaataaaggaaaactaataccaaaagctgtttgagtttttgttaattgtaacaatctattatctaccgcatggcttggagtataattagcattattttctaccatggacattgctgaaaaaatgcttgcatctaagttaggttcttcattagcagtttctacacttgctgatccataagatacttgagtaggttttaaccattgatatgccggaatcttagcagtttcatctaaaagtatatatgcaaatatttgttcaaattgttgtatatttatattaaaccattttctaaaagctaaaattataagatcttttgcctctgcatccattaaatcattagtatcagttagattgtaagtaactatcaaaacattttttagttcatcatcatttagctttatttttagattgaattgttttccgtcattttttccagtagagtcattaatagttgttttagagttaaaatatgttagatctacttgaatcaaaaggaaatcacctgtagatgaattaaatacatcattctgaacaatataaattgcagatttaatcggacatttaaatctgatatttcgtccatctgcacccgtggtcatttcccaactatcaaatgttcctattgcgctagatttaatgtaggaaccatcatgtattgcgtggaaatcttttgggtataggttatcttttttaataaattcattcatagtcctaaatgatactgaattctcagtattccatcctaataagcttaaatctcctactactttagtttgaattctagatttattaataaacatttcaatattttttatattatttttaaaatataaaagcattaatttatttaaatatttatctaaaattaaattatcttttgaaatttttaaggaattgtctttaatataaaatgatgaactctttttagatattgaataagttccatctgagttaggagtgatttttatacaaagttttatccaaacattttttaaaggaattttttcagaagaagctccaaaattcatatctaagtatccatcatcaattatacattttaagactggataagatccttcaccttcatctgttaggttccaagctttccaagtaccatttagtgtggaattagtgattttggttccattaagttccataaaaaaagttttaggtataatttcatttatagaatagttttcttttgtattttttaaaattgtttttttccaatcgtaaaatataaatggttttaaattattcataaatgattctcctttatgatatttgtaataaattttcctcatttcctagtaaaatagataataataatctatttaaaataatctcttctagaattccatttttgcttatttttttattaatatcttcattaatgatatataagttaaatctattttctagaggcttcttttttatatttgtaaattcgtttaaatttttattacttgagaaagatagttttaaataatctttttttaaagctattaaggatattaaatcttttaagtcatatttttctaagatatctccagatttattttttatatgaaggtaaccttcaataaacttaatcttgaagtattgataattaggactacaattttgatttaccttttctaaatgaattaatccattagaatttgataaagtgtcatcaaaattaaaagaaaatgtttgcttcatattatacctccttttttattgtttagtattgtttagttctgttaagttatatgaatattgatttctcttggcctattggaatataatagtttcaccataaaatcattacctcccagaaaggagagaaacatcaatgaataaaactagtaaaatttattgtcctaaatgtcatagtaataatatctacaaatttggtaaagcaaagatataagccagaaatatcaatgtaaagagtgcaagaaataactcgcacctgcggagcagaagtatcagcttatttgttatcatctttgtcctttgtggcaaaggaacatttattcatcacaattactcaaattacattaattattgttgtaacgataaaaagtttaatcatattctctttgtagcgaagcctatggctataaccgccttcaagtaataatactatatatgtcaaattagattttgaaggtatgagattcccactccatattattttaatgacattggatttttatttcctcaattaaagttctacaagaaggatttctcaatatttatttagattgtttaacgtaaaagtatctcatgtaactattgcaaattgaactaaaaaatttgctacctatttccgattaaaatctaatgctactactaaaagggattagtttatcagattatgatgaatggcataaagatgaaactattatatttatagatagtaaacatcattatctatggcttgtaattgaccctggaagtcgtcttattatttcttataatttatcatcatatagagatacatagcaagcttttagcttattcaatcatactaagaaatttggttctcctagagctatagttactaacaagcccctttcttataatgtaccaatagaatcaatattttaataaaatatttaaatcctggtatgaaggcttaagggttttaattcctttgatggtgctaacaaactgatagctatatttatatttcattataactttctacattaacactattcatgacatgatttatcgtctacaggggtaattgaaattatttatccatctaaagctaaaaagaattgattgttaattgtctaatggcatacgctatccctttgtttgaatctatttatttttaaaatcacattatggatagaatttttattgtgccttaaaaatataaatttgctatctgttaacctctaaaacgaacataatagtaattgtgtgatttttaaagttattttttcataattacttaacacaaccgtgtatatatattaacatctctatattattttttgtaaacctaaaatataaactatatattaataagttcttttaatataggctttagtttttctaatgctaaatttttatttttatatacagattgacggcttatcttgagctttttagctatttcaatatctttcatatctttaaaaaatttcatatatataatatttttttgattattaggtaatatagatattaaatctttaaattcaaattctatatcattaaagcaattatcttgtattaaatttaaatttatatctgtaatttctgaattgtatataatttttttgtctctattctttttcgtacaaatagataaacaatatctttttaaacatttactaatatatttatttaaatcattttcagtgttaaatttatttaaatcagctttttttagaataatccaaaaatgatttagtatatcattgtaattctcagataagttatattttttaataaatatatctataagatttttataattcgtataaatgtcttcaaattttttattatcatcttttaatatttttattataaagaataaattttccattgttttcactccattcagtccctggtataattttatattatatacttaaaaagtaaactaaacaaatattatgcagtatcaaatactttattaatattggataatatttgttaatatacttaaaaagtaaattaataagtttacaaaaattgatttggataagttatatatttatgtaacttaaaataaaaggggcgaatttatatgaatacttatggttgggatattgtctatggctgtagtaaaagagttgtaaataaacatttagaagagtatattactaaaaataaagttgagtttctatattctaatacagctaaaaaacaagaaataaaaatgaactttcaaagttgggaaattattaatgggggaacatcaaattttttaagaattaagattttaattaagaaaggatattttaaagttaggaatactactattgacctaagtggtattaatccagttttagaaattaaactagatttctttaatgatacttcaaatcctaatgttaagaaacttaaatttgattttggatctgaatctagtgataatattaaggtcatagtttcagaccttagtggaaaattagatgaggaagaccaattttattttaataaattgctaatagatacttttatccaaaatgaaaaacaagtttcttatatatttgctagtttaaatgttacttctaatatagcatggatgaatcccaaacaatttaaatttgtgtattattctccaactaataatagtgatggttacttatttattttatcagtagtaacaaatagagatatttctaaattaagtactaatgtggatggaaatattttatctaataacagtgaagtaggattacttatatcagaaaaattatttttccaaaacttagctttacctaaactttcaagtaatatgggatctgatattagtcaaaaaaattttgaagtttcaagttattcagatactacagcaggtatttacaatagcagtaccttaaactggtatggaattaaggtaggacttatttggtattaccctaaaataaacagttttgtcttgaattcatatgaaggaaataaattaaatataaaagtgtccggaagagtaaaacttacaggatatgaaattgtatatgctgatttttctataagtagtattaataagtttatgtatgattctaagaataagagggcgtattttgagattgataaaaacgctaaaacagataaaaaaatttatatacgtcctgttgaccttatacctgcagctataataaattcagtagtatattggtctatggaaagtatcaaagaagcattaggattccaattagcaaataattttacaaatataataaatgatattgtaaattggaataatttaaaaatttcagaggttacaaatgttatttttaatgttggattttgtatacaaggaaaagcaaattaaagaaggtgagaatatatgaagataaataataattttaatattaattctctagtagataatagagatgtagcaatcgttagggggagaaaaacagatgctttatttaaagtatttcaagtggctcctaatatttggattgccccagaaagatattatggagagtcattaaatataaatgaagatcaaaaatctgatggaggaatttatgattctagtttcctttcaacagataatgaaaaagatgaatttttacaagcaactgttaagatattacaaagaataaataataatgttataggtgcaaagttattatctttaatttccacagctatttctttcccttatgaatataaacctggagattatagacaaactaactatcttacttctaagtataatgaacattattatacagctaacttagttatttttggaccaggatcaaatataataaaaaacaatgttgtttattataaaaaagaatatgcagaaaatggcatgggaactatgtcagaaatatggtttcaaccatttttaacatacaaatatgatcaattttatgttgatcctgctttagagttaataaaatgcttgataaaatctctttattatttatatggaataaaacctagtgatgatttaagtattccatatagattaagaagtgaacttaataattcggaatattcacagttagatatcgttgattttttaatatcaggcggaactgactataaacttttaaatactaatccttattggattacagataattattttagtgatgctccgaaaaactttgaaaaatataaaaatgattacgaaacaaaaattaaaaataataatgatattgctaatagcattaaattatatttagaacaaaagtttaagattaatgtacaaaatatatgggaattaaatttaagttatttttctaaagaatttcaaattatgatgccagaaagatataataatgcacttaatcattattataaaaaagaatattatggaatagattattttagaaattacaatataaatggttttgaaaaggggcaaattaaaacaaatttacctttatcaaaatataacaaatatattataaataagcctgaattaatagttaatttaataaatcaaaataatactgtattgatgaaaagtaatatttatggagatgggctaaaatgtactatagataatttttattctagttataaaattccatataatgcaaattacgaacatcctattaattattcttatttggataatgtaaatatcgaagaaatagataaaattcctcctatcaatgatgcagatatatatccttatagaaaaaatgctgatacatttataccagtatataatattataaaatctaaggaaattaatactaccacaccattaccagtaaattatttgcaggttcaaataacagatagcaatgatattaatttatcgtcagactttctagaagtaatttcttcgaagggatcttcagtatactcgtttttaaacaatacaatggattatttagagtctataaaatatgataagcccattgatacagataaaaaatattataagtggttaaaggcaatttttagaaattactcttttgatataacagaaactcaagaaattagtaatcaatttggagttactaagatagtaccatggattggtagagcattaaatattttaaatacaaataattcatttatggaggaatttaaaaacttaggacctatttctcttattaataaaaaagaaaatataactatgcctaaaatagaaatcgatgaaataccgaatagtatgttgaatctttcatttaaagatttaagtgaaaatttatttaatatatcttttaaaaacaactcttattttaaaaaaatatactatgactttttagatcaatggtggacacaatattatagtcaatattttgatttaatttgtatggctaaaaaatcaatattagctcaagaaaagttaataaaaaaaataatacgaaaaaaattaagttatttaataggaaatgctaatatatcatctgataacttagcattaatgaatttaacaacaacaaatacattaagagatatttcaaacgaatcacaaatagcaatgaataatgtagatagttttttaaatgatgccgctatatgtgtttttgaaagcaatatatatcctaaatttatttcatttatggaacaatgtattaataatataaataaggatacaaaagaatttatacaaaaatgtactaatattactgaaaatgaaaaattacaattgattagccaaaatatttttagtagcttagattttgattttttaaatatcgaaaatttgaaaagtttacttagttcagagacagcattacttataaaggaagaaacttcaccttatgaactagtgttatatgcttttcaggaactaagtaataatgttatcggagatgcatctggtaaaaatacatcaatagaatattctaaggacattggtttagtttatggaataaatagtgatgcattatatttaaatggatctaatcaaagtataagtttttctaacgatttctttgaaaatgggctaactaatagtttttcaattcatttttggttgagaaatttaggccaagatactactaaatctaagttaataggtagtaaagaagataattgtggttgggaaatttattttcaaaatactgggctagtttttaatatgatagattctaatggagatgagaaaaatatatatctatctgatgtttctaataatagttggcactatataactatatccgtggatcgtttaaaagaacaattattaatatttattgatgataatttagtagttaatgaaagtattaaagaaattttgaatatctattcaagtaatataatttctttattaagtgataataatgcaagttatattgaaggattaactattttaaataaacctactacaagtgaagaagttttgagcaattattttaagaatttgaataattcatatataagggacagtaatgaagaacgattagaatacaataagacatatcaattatataattatgtattttcagataagcctatatgtgaagttaaacaaaataataatatatatttaacaattaataatacaaacaatttaaatttacaagcttctaaatttaaattattaagtatcaatccaaataaacaatatgttcaaaaatttgatgaggtaataatttctgtattagataatatggaaaaatatatagatatatctgaagataatagattgcaattaatagataacaaaaatagcgcaaagaagatgataattagtaatgatatatttatttctaattgtttaactctatcttatggcgataaatatgtatgtttatctatgaaagatgaaaactataattggatgatatgtaacaatgaaagcaacatacctaaaaaggcatatttatggatattgaaagaagtatagggggggatttttatgccagttgtaataaatagttttaattataatgaccctgttaatgatgagacaattttatacatgcagaaaccatatgaagaaagaagtagaaaatattataaagcttttgagattatgcctaatgtttggataatgcctgagagagatacaataggaactaagcctgatgagtttcaggtgccggattcattaaagaacggaagtagtgcttattatgatcctaattatttaaccactgatgctgaaaaagatagatatttaaaaacaatgataaaattatttaatagaattaatagtaatcctacagggaaagttttgttagaagaagtatcaaatgctagaccatatttaggagatgatgacacgctaattaatgaattctttccagttaatgtaactacaagtgttaatataaaattttcaactgatgttgaaagttcaataatatcgaatcttcttgtattgggagcaggacctgatatatttaaagcttactgtaccccccttgtaaggtttaataagtcagataaattaattgaaccaagtaatcatggttttggatcaattaatatcttgacattttcacctgagtatgaacatatttttaatgatattagtggagggaatcataatagtacagaatcatttattgcagatcctgcaatttcactagctcatgaattgatacatgcactacatggattatacggggctaaggcagttactcataaagagtctctagtagcagagcgaggacctcttatgatagccgaaaagcccataaggctagaagaatttttaacttttggaggtgaggatttaaatatcattcctagtgctatgaaggaaaaaatatataacgatcttttagctaactatgaaaaaatagctactagacttagagaagttaatacggctcctcctggatatgatattaatgaatataaagattattttcaatggaagtatggactagatagaaatgcagatggaagttatactgtgaatagaaataaatttaatgaaatttataaaaaattatatagctttacagagattgacttagcaaataaatttaaagtaaaatgtagaaatacttattttattaaatatggatttgtaaaagttccagatttgttagatgatgatatttatactgtatcagaggggtttaatataggtaatttagcagtaaacaatcgcggacaaaatataaatttaaatcctaaaattattgattccattccagataaaggtttagtggaaaagattattaaattttgtaagagcattattcctagaaaaggtacaaagcagtcaccgtcactatgcattagagtaaataatagggagttattttttgtagcttcagaaagtagctataatgaaagtgatattaatacacctaaagaaattgacgatacaacaaatctaaataataattatagaaataatttagatgaagttattttagattataatagtgagacaatacctcaaatatcaaatcgaacattaaatacacttgtacaagacaatagttatgtgccaagatatgattctaatggaacaagtgaaatagaggaatatgatgttgttgactttaatgtatttttctatttacatgcacaaaaagtaccagaaggtgaaaccaatataagtttaacttcttcaattgatacagcattattagaagaatccaaagtatatacatttttttcttcagagtttatcgatactatcaataaacctgtaaatgcagcactatttatagattggataagcaaagtaataagagattttaccactgaagctacacaaaaaagtactgttgataagattgcagacatatctttaattgtaccctatgtaggtcttgctttgaatatagttattgaggcagaaaaaggaaattttgaggaggcatttgaattattaggagcgggtattttattagaatttgtgccagagcttacaattcctgtaattttagtgtttacgataaaatcctatatagattcatatgagaataaaaataaagcaattaaagcaataaataattcattaatcgaaagagaagcaaagtggaaagaaatatatagttggatagtatcaaattggcttactagaattaatacgcaatttaataaaagaaaagagcaaatgtatcaggctttacaaaatcaagtagatgcaataaaaacagcaatagaatataaatataataattatacttcagatgagaaaaatagacttgaatctaaatataatatcaataatatagaagaagaattgaataaaaaagtttctttagcaatgaaaaatatagaaagatttatgacagaaagttctatatcttatttaatgaaattaataaatgaagccgaagttggtaaattaaaagaatatgataaacatgttaagagcgatttattagactatattctctaccataaattaatcttaggagagcagacaaaggaattaattgatttggtgactagtactttgaatagtagtattccatttgaactttcttcatatactaatgataaaattctaattatatattttaatagattatataaaaaaattaaagatagttctattttagatatgcgatatgaaaataataaatttatagatatctctggatatggttcaaatataagcattaatggaaacgtatatatttattcaacaaatagaaatcaatttggaatatatagtggtaggcttagtgaagttaatatagctcaaaataatgatattatatacaatagtagatatcaaaattttagtattagtttctgggtaaggattcctaaacactacagacctatgaatcgtaatcgggaatacactataataaattgtatggggaataataattcgggatggaaaatatcacttagaactattagagattgtgaaataatttggactttacaagatacttccggaaataaggaaaaattaatttttaggtatgaagaacttgctagtatatctgattatataaataaatggatttttgtaactattactaataatagattaggcaattctagaatttacatcaatggaaatttaatagttgaaaaatcaatttcgaatttaggtgatattcatgttagtgataatatattatttaaaattgttggttgtgatgatgaaacgtatgttggtataagatattttaaagtttttaatacggaattagataaaacagaaattgagactttatatagtaatgagccagatccaagtatcttaaaagactattggggaaattatttgctatataataaaaaatattatttattcaatttactaagaaaagataagtatattactcggaattcaggcattttaaatattaatcaacaaagaggtgttactggaggcatatctgtttttttgaactataaattatatgaaggagtagaagttattataagaaaaaatgctcctatagatatatctaatacagataattttgttagaaaaaacgatctagcatacattaatgtagtagatcatggtgtagaatatcggttatatgctgatatatcaattacaaaatcagagaaaataataaaattaataagaacatctaatccaaacgatagcttaggtcaaattatagttatggattcaataggaaataattgcacaatgaattttcaaaacaatgatgggagcaatataggattactaggttttcattcagatgatttggttgctagtagttggtattataaccatatacgaagaaacactagcagtaatggatgcttttggagttttatttctaaagagcatggttggaaagaataattcagaaaataggtattaaaatagaggtaatatatattacctctattttggaataattttaatatattatatgaaacatatataaatttaaagataataattcttagcgaaaccagaaatgtcagctgaattattattctcatggcttatatatggaaactgcctaaattcatgaaataatattgttcgttttccattgtatatatagtccgctaatttattaagctcaattcctaattctgaacaatttctaaactttttaatatgctttgcaatatctgtcatatgaaaactgtcatttggcataatgccaaaagcatgaaatggtgtagattttatatttttcactaatttagtataggttcctcttttaaacattcaattttaccctcctcaattaatatatttgtattgttcagctaatcagtttttaaattatcaatatatttattatattcttcatctgaaatagcccctatctcatgcaaaatgtcttttgtactccatgtactaccttcttccctaaaatcaccaatagataaatcaaaactattatcttctttataaaatactttgcaccattctaatgcatcttcaagtgaatcagccataccaccataaagtactccatcttttatcttacaataagaaacctttctatctccatttcttaaagcaaatgctacacatttattaaataattcatggttcataggataaaacttatcacttcttttatcattattagtaatcatttatcttcttcctccttattaatgaacaataatttcaggtcctgcagctgttttttgaattacgaactataattcttcatagactttatcactatataattagctttctttacataataactacgccgaagtaataatcagccgaatttaatatgatatgagtataatgtttatcatttaacggtattattttttttattttattttgttctaattctatattaagttgtgctacatcacttctatcacaataacctgcaatatcatatttatcttctcctacagaaagtattgatccatttaaaatataccctctattagataattcttttagttcatattcatcaagtttgcttaaatatgttgcataataaatacttttccaaggtaactatatattcttgtataatgtagtaaattaatacttaagctaatcaaccaagcttaataggagtactcctacaagcctacgaatttattcgtgggttagttgacttatcttcacattatctctccttcctaaaacttttgagtctaacaacaaattttttaagtacttatatattactaatgtaataatcttttttactcattcttacaatataattttatttaattagcatctgtgcaaatcatattacatgtttatatttattcatttctcagaatttctagtttctaaattataaatattaaatttatttagatatccttatatttgagcataataaaaaaacagtatatgagtataatactgtttttttatttatctttatattgttaattataatctatctataaattttttatattcatattataatttctatttgaattcatttaagttcataatatactctttccagtctttaaaactaaaaaatattatacgtcttcccttattattttgatatttagcttgtttatacgtaggtttattatctataaagtcccaacaacgtgtgccatcattatatactgaataataaatacctgatatactttttacccaattataacaaccttgaaaactataatcatcaaatggaatcccatccttaattggtctgttgatatgccattgccataaatgttgtttatagattttttttacaaactgctgcaattctataggttcattaaaaaaacgcttccatacttctattttatcgacatttaattttgcattggatattaaatatgagtaatcagaatccatactagtgtataatcttattggttcatcttcaaagtattccatggtttcccattgtttatcattaaatatttctctatcttttttatctaataaatatcttctatttacaaattgataataatttttaaataaccatttttcatctgctatacaatttctatctatttcattattattatcatcatattcaataatgaaaacttttttattattcacaatatacccccattctaaaaaacattaatttcactccattattacccatgttccactttgtgagtcagaaaacttagtataattatctttctaaacatttattatataaaaagtcacaaatattattagcattttttgtatcataaaaaccaatcattagtgtattgaactctaatttatcctttgcttttatatttagaactccttggccactagataataaaacaccactcttataacgtttaataacatcttctatatagatttattccatattaatcctcctcaacaggaaatataatttctgtaatgtatttttctagcttcccttttaaaaacatatcagaacctttaataaatacttctcaaaatttagtctgtaatctaataagtacgaatctcttgatatgcttaaaacatagtttcacaaaaaaacttgtgagtaatacataatgtccttttccttgacttcaacactacagtaggtacgcatagttcaatctctccaaatttagtttctggattcattgtaatgtagtacattaataaacactttatttgcttctgtagaaatcctcttatatctcataaatgctactctaatagattctatttttctaatttctacttgatattccattgtactaactctccttttctttttttatactcatccatatttctgcatatacactaactcttatttcatcatatactggatatacttcaacatctgcaatttctgtatatctatatcctgaaaacggaagccattctgtaaagaaacgtttgtatatagtttgtatggattctttgaacagaccttggctctcaaacacagcccaaattgatgcaggaatttcatattcatacattccttctggtacaggtttatccgtaacagcagcaatataataataaacttcatcactttcattataaattgatattccaaaaacctttttttgtggtgtattatttagatttaaaatttggcaaaatatttcactttgctttatttgttcccaaaatgacgaaattgatttatagtttttatccatatcatatgttaatggaatacggacaccaacaattcttattgggcctttttcttcgattttatatggcatctcatcacctccttgtgtttgaattgagaatttaataggaagatatctgcacaaagttgacatccttgggattttgccatgtcagggttaatgtcatgtacgctttgaaatagatgattgaatgtcgttggcgtgaaatatccatatctaaattctgttttatataatcaatagctttactcaaattttttaaccactccattattttacctacttgctattagcataccctataatgtaattcatttcctcacattttttaatttaatttgtaaacataaattattttctaaatatcaattattcatcactctatattttaccatttgtgatatattaatggtaatcatatattttttaaatgatttcttgtaaatgtatgttgttattatttgagatattttctaatttttcttttattaaacaacgatataaatatctttgtttaatatcattttctgatattggttttgctccataatacttattaagtatattttatttctatttccaaaagagccaattcaaattccgcccaatttatggtataattctaattaatgtattttttaatatttttagtaagttgactgattgctaaagcaatagaagtaaaggttctgctttctcgtaataaattataactcttcaaacaaactaaaaaattaaaatattaggaggtaaaaatgaaatttatattatttattttaattgcatttatggctattctattactattacttataatcggattactattacctaaagatagaatagcaaaaagagttgttactttttcctctgacataaagacagtttgggatgtagtaactaataatgaagattatgactggagaagcgatatatctaaaatagaaattctagataatggagattcttggattgaatacgctcttaatggtagccatataaactttgatattcttaaaaagaatgattgcaaagaatatgatttcaatatgaataacaaaatgtttactggaaagtttactagtaggtttgaaaaaaatgctacagaaaatgcaaaagttgaatttgttgaatctatatctataaaaaatcctatacttaaaccaatatcatatttattttttgatattcaagggtttcaagatacatatatatctgatttgaagaaaaagttaaatgaataattaaaaaagtagattaagggatgtaataaattctgtgtttatatagatttatctacatccctatataagctgtaattataacatatcacttataacttcttttatttttttcactttatttaatctttcccatggcaaatctaaatctaatcttccaaagtgtccatatgctgctgtctgcttatatattggatttctaagttctaattcattaataatagataatggagttaatttaaacactttatttactaattttataataaattcatcagaatactttcctgtactaaatgtatcaatactaatagatactggattagagactcctattgcatatgctatttgtatttctattttatccgctaccccagctgcaactaagttcttagcaacccatctagctgcatatgcccctgatctatcagcctttgtaggatcttttcctgaaaaagctcctccgccatgttttcctacaccaccataagtatctactattatttttcttcccgttagtccagaatcaccttgtggacctccaactacaaatcttcctgttggattaattaaaatctttgtatcattgtctataaatttttttgggatagttttttctatgacataatcaattatatcctgttgtattttttcattagaaacattatctgtatgttgtgtagaaacaactatgcaatcaactcttttgggaacatctccatcatactcaactgtaacttgtgtttttccatctggtcctaaataagttaattcattatttttcctgacgtaagctaatcttcctgctaacttatgagctaaaactataggtaaaggcatatattcaggcgtttcattagcagcaaaaccaaaaaccattccttgatctccagcacctatttcttttactttatcaactcccattgcaatatctggagattgtttgtctatactagtgattaccgcacaattcttacaatcaaatccgaattttccatctctatatccaatatcacttattgtctttctaactatttcagaaatatctacatggcattttgtagatatttcacccataactataaccattccagttgttacaactgtttcacatgcaattctagcattttcatccttagatataatctcatcaactatactatcagaaatttgatcacaaattttatcaggatgtccttccgttactgattctgatgtaaataaacttttcatttcttattccttctttcatttcttatttctatctcttttccattatcaaaaattagtatactatcaccttcaacaatgttaccttctactatttttctacttattggtgtaattatcttactttgtattgatcttcgtataggtctagcaccaaattgtaaatcttctaaataatccagtataagtaatttaacattttcagttatattaactttaatattcttattttgtaattgagctataaactctcttaactgtaaacttataatcttaattaaactatccttagacaatggtttaaaaataatactttcatctatcctatttagaaattctggtgaaaattctttaattaattcttttttaattttttgatttagcttttcttcatcatcttcttttaatatatctttactgccaatattagaagtcataattatgatagtatttctaaaattaatagttcttccttgtccgtctgtgactcttccatcatctaaaatttgtagcataatatttactatatccctatgtgctttttcaatttcatcaagtaaaacaatagaataaggtctgcagcgaactttttctgtaagctgccctccttcctcatagcccacatatccaggaggtgcacctataagcctagctagcatactcttatcttgatattctgacatatcaattcttataacagaatctatatcattaaataatattttagctaagttacatgctaattctgtttttccaactcctgttggtcctaaaaatatgaaagaacctatgggctttcttggatttgataaacatacccttgatctaataactgcattggatacagcttgtacagctttattttgtcctattactcttttctttaaatgactttccaaatttcttaactttcttgcctcatcttccaaaagatctgaaactggtatctttgtccatttgcttactatttcagctatatctgactttttaacttcaataacatctgatgaattatctctatcaactttggaaataatcttctttcttgccgccgcttcatctaataaatcaatagccttatctggtaaaaatctttctgaaatatatctacttgataaagttactgctgcttttattgctgacctgttaaactttacattatgataatcttcataaatattttttattccatctaatatatgaattgttttttctatagacggttcttcaactaatactgttttaaatcttctttccaaagccggatctttttcaatatattttctatactctttaattgttgttgcaccaatacaatgtaactctcccctagctaaagcaggctttaaaagattacttgcatccataggaccatctgtgcttcctgcacctactaaagtatgcatttcatctataaatagtattatctgtccataggaattctgaatttcagttataactttttttagcctctcttcaaattcacctctgaacttactacctgcaactagtgctcccaaatctaatgagtatattttcttatttttaagttcatctggaacttttccttgtacaattaagcaagctaaaccttcaactattgctgtttttcctactcctggttctcctattaatacaggattgttcttgctttttcttaacaatatttctatgacataacctaattcatcttcacgtcctaataccatattaaacttattttccaatgcacatttagttaaatcaattgcatatttatttaaaaaactttcttcatcactattgtaattcttttcattactaaactgaattttagataatccctctaaaattttagactcatctatccctttattttttattttctttcctaaagtgctatcttctttagaaagtgctaaaagaatatgttgtgattctattagttcatttttcatattaattgcttctatagatgctttcattataatttcttttaatgaatcactagccactatagaatctaacatctcttggctatatcttatactattcttatccttatattctgaaacgacttcatttataagatcttttacatcaatattcaataatctaagtattttataaacattagaatttttatgtttagctaacactataaaaaaatcctctacttctatccttgtatgattaaattttatagctataaattttgcttcacttaaaacttgcttaagctcattatttaatttattcataaatctacctcttccatagtgctataagtttttcttatattattttttaatacaacacacattccaacaagagttaatgttaaacctagaacaataccaataaaaacgccattctcttgtaataaaatggagaaaattaatgaacttccaacaccaaatatccaatacaataaaagtactaatacgagaggagctttagtctctttgaaacctcttaatattccagcaataattgcaataatactattaattacaaaaattattgctatccaatacatatagttgctagctaactcaattactgacatatttttataagaattatctattatcatataaattaagctatggtttttaattattattagtcctactattattactgcatatactaagaacaaggtaaatgctgatttaataactattttattttttactttattcttttctcctattgtttctccgactctcatagaagcagaatttgcaatgcctattggaaacatataaaaaatatttaaccattgaatgacaacattatatgctgctaaggaagtagagctaagtcttcctattagcaaacttgttgctgtaaatataaactgttctgaaaaaaaagtaaaacctgatggtatgcctaaattaataattttataaataatttttttagatattgtcccgcctttagctagcatatactttgatatttccttattgtacgcatatttgacatataaaaatatggcaagtaattgcaaaatatttgtaatacttgtacttagtgcacaacctactactcctaatccatggaaaaatttattatcatatatcaataaataatttccaaagaaattaataactactcctaagagtgaaataatacttgaaaatttcacatctccatacgttgctaatatcaatctaatgaacataaaaattgtccatggaataattcccggtattaatccatatgcatacatataagacacattaactacagcactatcatgaattataaattttacaatccaaggtataattattaaatatagcacttgcactaaggcagcacctatagaaattaagtatccgtttttcattaaatcggatacccgcctattattattctcccctttagcttctccaactaaagggggtataaccatgactaatcccatacaaaacaaatatgctaataagtttagggaagataccaatgcttcacccgctaaaaatttttcgcccaatatactaatcatatacacatctatagcactcattaatatctgtgacagctgtcctagtgctatcccaatccctacagtagttaatgttttacattccattttaaactctgatttattcttttttaaaataaacatctaaaatcatatcctttaaaactttaatagattttatttatataaatgttgtgattcctgtttatttgtatttcctgaaatagctgcatattctttttcctgtacttccttaagactttctgatgtattgtttttgaaaattgacttagtaggagtatatccatgcactaaaaattcaacaaatttatgattttctattttagccgtaatatgcatgattcccatgttgtctggtaaatagccaagttcatcgcctgtctcatcaaaatacatatctactgtatcattaacaccactaccatcaccctttaaaatttttggtttatgaggaatagatacgccattcatagctgaatttaacacatctgcagctataattggtgtaatcggtgtcttgaataatggatgatatattattcctttttcactaaatagtgataaaaataatcccatattattattagcccaagcttgtccaactaatttaactaattccttggtatcaatatctccaatgtcaacctctttaagttctctttctgatgttggattatactgaattaattcatatccaggcacctcaaactttgtgaatttatgatttttaattgttgcctcaattaccattcttccggcatattgcggtgtgtatccagagttctctcctgaatcaataaatttcatttcaataagatcatctattccatctcctgtgccattaattaatttacatccatcgtatactgtagttccacaaacagtacaatttaaaacatctatgacagtattaggagatactccttttgtaaaaaatggatgatctattatcgcatcttctgagaataaatttccaaatcctttaccatcatttttaccccaatattcacctgctagtccagccatttctatggcacttaaattactcatataataaaacctccctttattatctaagtgaattacttattttatatccataaatgtttaaataacttatcctatgttttttcacagtggcactaaccataattttccctatattagatggcttgtatcccatttctgttcctgtttcatcaaatgttaactcaattacatcatcttcaccactaccatcaccttttaacagggcataatctgataattttgtaattcctttagcattgcaattcatgacttctgctataacttgtggtgcttcttctttatctaatactacatgttttatttttgcatcatcactaaataatgatacaaactcattaatattattacattcccatgtttttgctaatttttctgctacttcttttgatgttaagtctccatagtctatagttctataatttatatcttctgtacttttttgcaataattctatttctacaccttttgtatctatcttataaataacgtgatctcttatataaacataaactatcattgagcctatatatttaacatcttcatcaatttgatctcctgtctcttgaaattttactctaactatgtcatcttctccgttaccatttcctaaaacttgttcatatcctactatattagtataaccttgaactggtgcattaattacttccatagctactgccactttaacaggctggctaaaatatggatgactaactaaagcatcctttgtaaataatgatacatatccatcaaaattattattctcccacatttctcctaaagtacttactatttcccttgttgataatttcttcattataaattccccctttgtattactgacttatagaaattcctctttcattaaaaatagtatttaaaaacaactcatcatttttccagtcaacctgatatatcttggcatctgatatcgatggcaaccccaatattaaatgagataagttcattctataatctgctataatagttattggtatcttgtgggctgaagcccatccaagctctattaaaactccatctgatatataatcactaactatcgctactaaatgttttgatttaactaattcatcgtaatctcgtttagtgcattctacagaagtaaccttttgtcttccccatttctctatatctattgcaaggaaaatattatatccctccatagttagaagatcaaaaattctgttaatttttactgcagttttgctatgcaaaagtcctgtttcaggattaattgcttttgagataggagttgataaaaaaatttgttctcctcttttaactgttttatttttactcattaccctttctccttaaccaaaaatactaaaagttcctatcattttcataatattttattggaccatcaatacattcttcaatttcatctagtatccaagacggtctaggtctattttcttttataaagaattgtgaagtttccttattgtttggtatttctccttctgttgtataaggtaaaatatctgaagttccagggcttaccactccaataacgggtaataacttttttaatatattaatatcttctcttgtagtaagaataattttagcccacggacatgcttttgctactgttaaaacactctttataaattcatcatcgcttacttcataaggtatctcttccatacctctaattcttggcatagatatttctacttctgctcccatttcatgaagttcattagcatgtttaattaaagaatctatatccttacttacctctgttaatccaataagtattccaatatttatccttttaaaaccttttgagatccatctttttggtgttgataatctaaaattataatgagatttaggaatacttgatacttcattaccaaaaaaactatgatatgcattaatatcataagtttcttgaaataaagataaacatagtttatctttatatttatctttaaaaatattatataatctattgatttcctcattagttaatgaaccaatattaaaattgaccttcttaaatcccatatcaaaagcagcttgaattgtttctattatcatattgaaattattttctctttcttctccttctaaaaattctcctgacaaaataagtacagctcttactttttctatttcatataatattattaactgctctttaatttcttttaagctccctcttttacgtttcatatgattattacttttcctcatctcgcaaattttacaatctgaattacaataattggttatatatataggaactatagtttcaatttcatttttccttactttttcaatgctattttgaatatccttaatatcatatttatcacacatataactactcctttattttttaatggctgtcaccaccacttctactaaattatctctatctaacgagtaatttcccgacagcaatgtcactaatatgacttcaatatttgagctaatattattctcattacacatttttcctaataaatcatcatattcttctattgttaatatctcatatatccttaaaatatcatctttatttaccatataactcgctccattttataatattcccccaatttaaaaattaggggaatattaagcaaactactttttgatagctgtaacaatcatttcaagagtccatggtggagctgatggtcttcctggcaatgaagtaacatcaataattttaaaccctaattcttctatctctttgtaatactctaaacacccttcttcagtaaatgcttctaattcatcatgatccacaaatgtacgtattttttcatcttcttcaattatcaatactggattccattcaagaaataatccttctttttcccaaggttcaattcttgctacctttgttccttcaacttcctcatattgaagtattgtttttgaatcattctccaaattatccttaagatcttgaagaatcataaatgatattattccacctttttttaatgccttatgagcattctttaataacttaatttgtgagatgcgtgaaaatggaacaaacattgatataattgcatctatatcttttccacaactcatattcaatgcatctcctgctttaaattcaactaagctctttttatcagctgcaattttctttgcaatttctattgattcttcactacggtctataccaaaacagttatagcattctttttcttcaaacttcattataagagttcctgtaccgcatcctaaatctagcacagttttgactccattttcttgatatatcttatgaagcatttctacaatttcatcataatctagcaacttatgtcttaatatatcattgtacttaataattccctttggataattaattaaccagtctttttttacagaatttttttccatataaacacttcctttacttattcaatacttgaccaaaatcatatacttcttttggtcttaactctcttaaattacatccccataattgtgttttccctctattagaaaaactaaagaaacattttgaaatattatcaataaaaaattttcctttttgggttacaatcaacatattgtctttaatgtctatataatcatagctttttaacagagctatttcgtacttatatatatcctcaaattttatagaaaaaatatcttcaaattttttcatgtcaacgtttaaacatctgacccctaacgctggataacgtgatagtgcatcatcatatgaccatctttttcccatcaaaactgggaatttcccattttgaatcattgatatatactcatctgcatcatgaacattggcccagataaacccattaaagctttctgaaaatgcacctgctccaaagcttaaattttgacattgtgggctttgccaaagatcttgaatctgtttattctcatgacctggtaatgcataatcaggttgcgctacttgaataaatccagtttctttcatcttatcgaaaatatagttaaacatttctttttctgtctctaaactgttttgttcatctttaactttatttaactctctaacttcagggtctaaagcatagaaacttatactatgaacacctagatctaaagccatatttatatcttgagctaatccttcaattttttgatttgggaaattatacattaaatcgattgcaactgttttaaatccaacttccaaagcattttttattacctttatactcttaaatggaatttggtgaagcttaagactatctatattttctttattaaaagattggacaccaaatgtaactctattaacgccacatgccttaagtgatgctaagtaatctttaccaacagtcattggatgacattcgacagtaatatcacaatcacttaaaatatcgaacctactcttcatagtttttaaaatactatctatatgcttaggactcaatacactagcagttccaccaccaaaaaatattgaacttacttctagttctttagaaagggagttacttgaatataattctatctccttaattattgaatctacatataaatcaagattttgtggttttaatggttcatgagtaaatggacacatggagcagataaatttacaaaatggtacatgtacatataatgtagcctgctttgaattcataggaacactatcattcttcttccatacttctaatggattaaaatcccctaatctcaatggataacaccaagtataacaatcaactctttttccaagatctaaaatttcttttctatcaaatctattttgtatatcattaactgtagaatacatttttacctccctttactaatcctaaaatcaataatcttaggagtttttcctctcttagtcatatataaatcctctttgtttatttctaccttaaatcttaagctcccaatttctttagatgctgctaaatctaaagaagaatcccaaagtttcttaactatactcttttcaacttcttctaaattctctacttcatcagctgtctttactttaacaacaacctcttccaatcctgggaccaaagtgctacatactatttgataattacttaagttgattaactcaccttttaacacatcttcaacttggtaagcatataactttattccatcaaacaacactattgaatcccctattcttccatgaacctttattaaaggtaattcacatccacaagaacattttgtgggtatgagttcaataagatctcctaatctatatctaataagaggagttccctctccatatagacatgtaattacggcttctccaaacttatgattgttatttacacatttggcattttcaactggaagtaattctaaataatataagtcactcataaagtgcattccaccatttatgcatccgccacctaaaccatctgtttcttcacttccatataaatctataggttctacaccccaaaaatcctttatcaattttctatcagctggtaacattggttcgcctgccaacaatatatgtttaggattaacattaatgctgtcactagattttataatgcttattattgctttcattcttgaaactgatgtaaaaatagctgttggattataataactaattaaatcaatcatcttttcattaatctgtgatagtcctgctggaattgccataattccaagtctttcacatgcattcatagttaaatatcctagatgtgccatatcaaaaggttgtcctatataaatagaatcacctttcttaagacctgccatctttaataatctttctaacactatggaactcatttctgtatcattatgagtcctaaacaagctctttggattatgtgaagttccactactactactaactctataaatttcagcatcatcacaagcaaattcttttccatactttattaaatcttcagatgttacaattggtaatttgcttaaatcctctatgcctttaaattcatcaacgttaatattagcttcattaaatattcttttataataagaagaatgtttacctgcatgttgcaccactttaataagcttttcatttatatcttccataagttaacctccttgaatctttaagcaatttattcctaaaactaaaccaatatcatttctaaccttttacatatgtgatcaaaaaactcttcccctgctttacttgttgcccctttagaactagataatgttccgtttgcattctcatcctttttttcatctgaataataatatatccccgccataggtatattgctgcattcttcattaataaatctcaccttttcaggtcttagatacaacatcaatgaagtttctacaaatccagcatgttctgcatgccatcctacgaaattattattaaattttttcttaataaattcatcatctatagcactccaccaacttagtgcaactatactcataccttttagtagatttctttgtctgcatatttctatggcttcaaaaataaacgcttcattctcataatgaccatttataatatatagattctttagtcccatttgacaaaaagaactaattatatcaacaaaataatcaattaaaacctttccattaatacttattgtgcctggaaaatcacttccacctccactttgtggtagtgatcttgctgcatacattatttgaggtcccataacccaatttttcctgcagcacaatttcttacatatatctactgtgatatctatatctacagacaatggcaagtgtggtccatgctgttctatagttcctacaggcaaaaccaaagaattattattcaacaattccataacaacaggagacgtttgatcaagataatttatacattctcttttcatcttctatatccgcctcttttctttaatcttttaaggctttattaattatctctggaacagttattcccatgtctaaaaacatgtttttcaaatcatggattattctttctacttgattaataccattaataaaaatacatgaacatagctcaacagcactacttcctacataaagatattcaaggacatcatttgcattttctattccacctattccaataacttcaacatcagcattattttttttaagataatatatgttcttttgaactattggttttatagcaggacctgaatagccgcacctaacccctaaaggtaatgtaccatcagtattaacaactattgcaggtatactatcacttatacttactgattttgcaccagcacacattgcttttctaactttttcttctaccttaacttctgatgtcaatttcacactaacaggtacagatacttccctacatacagcccttgtaaaatcataaattttctcattaattccaatttcattaggacatgatattcctaactccaatgctttacatccaacttcctccatttgcaatgccaaatttaccaattcatctttagtatctgccacaatgctgggaattacaggaagattctccttatataatttacttaaaatttctgtccattcacttattgatttctttgaatatgttgttgaattgaatatttggctttcttttcttaatattcttccactttgaatattcttttcacctatatatattgtttttgtaattactgctccaacccctaaatcaaggaatttcctaatacttttttcattatctgttaaattgcttgatgctattattacaggattttttaacttcatacctaaaacttcagtttgtaaaggattaattttctcatcatttttcataatcttttttacctacttaattgtctgtggtaatgcccagctttccatccaactttttggaatatctataccaaactgatataatgccattgccatcattccttgatggaatacttcatgtgctattaagttagtaagatgagtttccaacgctatgctaatgtcataccacttaattactttattgccttttatattattaatacatttttcaagtctctcatcgctttcttttaaaccatctaatagcttatctctatttaaatctcctgaaaaatcaaatacatctggaacattatcaaagctcatatcctcattatcaatagctgttataaaagcattttcaacagaaatcatttctttaatgttttttacaaaagaatttaatccaggtcttgtccaagttttctttaattcctcatctgataattgatttaatatatcataagtaagttgtctattagctttataagtttctaaaaattcacctaacatctattaacactccattcattttttattttccttctctaatatttttcaagtgatgcttatatatttcacatttgtatttaatactttcttcattaactgttttgaaactacgtttcataaataaacatctttcacaaaaatgcttaggacatatatctttctcagtacatgatttgcactgttcaatgcctgacttatgattaattaaggctaattcccaattttgaaccaatatattcataaaatcatctatagaattcatattaaatattgagcctatactatttactttccctgaagcaatggcacatggcaatatattcccaaatggatctacttttaatgtaggagtacaacagtaatcatagttatatcctgaacgtatccatgctaataattgatttatcctatttactgatatataagtatctttattatcctttaataattcacctagaaaatactcttctatttctatctgcttatttaaaggtggtgctattttactccaattatcatttccatttcctgaagctatgagtgttggaaagtgtactgtccttattttattttttctagcaaattctattacttccttaacatcagtaatattttgattcataattgtcattgataatccaatctttttagcatatccttcctcaacaatatcttgaattgtatgcattgcttttctaaaatttcctattccacgtatattgtcatatgttttttcactaaatccatctaagcttatttgcaaaaatacattgttatttcttttaagaaaatcaatatatttttctgaactccaggctattccattacttgttacaacaacttttcccaccttacatagtccttcaataatcttttcaaagtccttatgtaaagttggttcgcctccagttacaacactatctttaattcctaacttgtataacttactatgaaactttaaaatttcatctgcatctaaaaaagttcttttttcatcagatacattgcaacaatgaatacaattcaaattacatccattagtaacctcatagtaaattctgtctgacaattttaacggtttcattgaaatctccttctactttgttacttaaaattagaattactttagttttaagaaagcagtctctaaaaattagagactgtcttcttaaacattattgttctactttacagcagattgccatcctgctgctgattgccagcctgttgcggattgccaacctgttgcagattgccaacctattactgactgccatcctgatgctctatttgcattaatataatacattagtcgattccacatactttttcacctcccataaaaattttctatcgtaaaaagcaaatctcttaatactataaatcctaagtattatcttttgtctccttacgatatctacatattactcctctttagatggtataataagtcacaagtttctatgattataagggaatgtgcaaaaatccaactcctttagatgtgggatgtatagtacaagataatataaaaaataagaggtacattaaaaaaataaaatttaatctttattctttcaatgcacctcttaatctttatttaattttcacatcaacatttctaatgaggcaagtttacccaagctctaaaggtcagaccaacctcgttatagtgcaaaatttatatagctaacttataatcttgttgcatattcttgacttttaagttcttaataactgttgattggttttatctaattagtttaattgatagcttaagaaatctgttttttgatttgttatcatttctccaactacctgtagcttgtcttatctttttctttaatcatcttatgatttttacttaaataaatataataaataagtccataaaaattttcatacatgcgtcttgactatccactttttcattattcttgctttaaatattaatttaagattacatccaccatagtattcaccttacatagtgcctcttttgtactattagcctgtaattttttcaaaatattagtgatgtgatttcttatagtttcatccgaaactactctcctacttgcaatttcttttctagtcaaaccactttttttcaaatttaaaatttctttttctgtgtctgtaaggttaaatttatctagaactttattaaatgtaatcttatctaataaattgctgtaatcatcaaaaatattttcttttccctcccataacattaaattttctattatgcacttaataataaatttaaaattatcttcatttaaatccttacttatacaggctgatatattagataaaacatatttcctatcacttgtaatattgataaacataacaaaaattgatggcaaattttctgtaactgctttaatcaaattattaaacttatcagttgtatcttcaaaagattttaggattaatattagttctggttttgatgttattaaactatttctaagttcttcttcatttaaatagcatccctgaacagtaatattgctattctctatcaaaaaaataggtatatctatatcacatacacttgatgaataatatattaaagcactcaatgccttcaaacatacccctcccttttcccttctttttcttttttttctatttaatactttatagtttatatattattctatctttttctttttttaagtactaaaattttatgacttgaatatttaacattacttccattacttataaattttgtatattttttaataaaaattaaattatgaaataattatgcaattctttaatattaaaaaaacacgctaagctcaatcaaataaagcttaacgtgcctcaaaattaggctgtattttaaataagtgttaaaaattgatatatatttacaaatatgttatagttaaactatatatacaagattgaaaatcatattatgacaaatgcaccgtctttaattttagaaacaggtgaaacaaaaataattttttttaaataattctatcattaagattttatcttattttcttattgatttaaatagaatgtagaatatctatatttcaaattttaaaaaggaattaggtgaacagcgatgacaaagaatgaaataatagaatacctaaataagattagttctgataaatttaaaaataatgtagtgaagatggggattccagaagaaaatagtataggtgtatctacaggggatataagaaaacttgcaaaaaaacttggagtatctcaaacattgtctaatgagttatgggaaacaggataccatgaagcaaaattactttccgtcttaattgctgatacaagcatgattaattttacttatattgataaaattatggaagatgttttatcatgggatttgtgtgaccatgtatgtaaaaatctaattataaacataccaaattacgaacgatttattttcgaatggtgtgatgatagcagaatatattataaaagagcatcatattgccttatagcaactacagtaatgcataataaaaatcttgttccagaagaaattgatagatatttagatttaatcaaatcttattctgatgatgatagacctcatgttaaaaaagcaattagttgggcattgagagaaattgggaaaaaggattttaattatcaagagaaagcaattattttagcctatgaattttgtgaaagctcaagtaaaaatatggtttggataggcaaaaacgctctgaaagaattagaaactttagtttctgttgaagagcgtggtcgattaataacatcaaattctaaaatgggcaaaaaaaatagattattggtataatctatagtcccaaatttcatatataatttccaaaattatactgataatttcatagaattctaaaaatatactgttactattaactatcttcaagtgctatccatctcccactttagaagtgggagaatttcacacaattaagttacaaactaattcttttgaaatttatttcctgaatctaatccttgcactgcaattttaatctattctctatgttaactgcttgcccgatatatacttgctggtttaccttgttatatatcatgtagattccactcttgatatccatattttaactccctttactctatcttttttcattaatcatccttttttctacatttatctaataatatgtttgccatatatacctctacacatagaattagcatatataaatatttaaacattatttatatatgcaatatattaaagaacaaaatgatccttcaccaaaaactaatccctgccaaatttaattatgtaaggggaatacatttctctattttattcaattcttaataatatattttagcattacgtgttagataccctttttctatccaatctttataattttttaatttacttttattaacttcaatttgctttttaaaatattctggagtaaagtaagtaaaattatcatcctctttttttacttttgtcttaatcatagtattaataaactcagcaattttaaatgaatcttgaagatagttttgatttacaataatttcatatggcataagttcatcaggaaatttaggtgggttcatgcgtgtaacttctttaatagtatctacatcaattaaattattgtctatcaacatattaggaagcatcctaaacttatatccgttccatgcatatctaaaatctccaaatattatagaatcaaaactatcttgatacactataatagccgatattttttctaaagcatctttatctattcctatttctaaagccatttctttatttttcaatatcccatttaaattattgtataataaagaatatggttctaaatatcctctttcttctacgtccgtataagtccaattaataaataaaagattaacatgatttttatctttaggtcgttgaaactttttaccagcactatttatatagtcttttaattttccaactcgtggtagaataaatttaaaatcatttagattacatatttttttcaattcttctttctcattttcttctagtaagaatgtaggaattattatacccttttcatttccagaaatctttttattgaatcctggcgtcttaacttctacatcaacagtaatcccatttgaataaactaatctagcttccggattgcttccattaatgcccaatttaggttcatatatggagtctatcaaatgtgctggaccaaatgatataagaaaattaattatatttatttctgacatagctctaaaaaactgttcttccatataattgcttttacctgctgataattgattttttacaaactcttcacaatctttttccttaaaatgattacaaaaatactgaaacttggggaaaaaattaagaataaagtttgtacaattattatcttccgtataagaataatacatgcttctttttgttaaatttctatatttattaaaataatccatctctccatttattgctttaataataaaatggttatctgaaaattcatctaatcaaccttttttattaatatcaataagatactttaaaaattcgttattttttcctatgcttcttttaaagtgtttcataataacctccttaatattattacaaatcaaaattctcatagtttgtattatacatatttttgtatgattgcaatacattttactatttttgtcatactttattaaacattgaattctgcttctcgtgcctcaataaattcattttcccaaaactcatctttttgtttttctaatttattatctaatgttagatctacaggagcatcaattaatgtgaaataccaccacatttattcagctcttgcaactgctctttgtattgtgaactattgccttttaaatgttttaacacaaaacatagtttcagtttcagtcgttttaacatcaacatcgtactgaacccccatattctcatataacatattcataaaagaatctatatcttcaaccttattcatttttgaagcccaaacacacccacatgcctccaataaagcttttttctcttccatagtggtggtatctttatcatatatacctttcaatatttgattgatttcttgtgctttcaatataactccgcctttcttttaattcatgaaactcctaagcctaaaggcatggagttcttaggtactatataacttatatattacctcgaaagtgtaataccactaattattttcctaagactttcactatcaaacagtcatgcgactatattaacgatagtataaggctcatgtgaacctcacatgactgaagccacgtgtttccctcattacttcaggatttcctgtttctatgacttcgtaacctactatctccacaggcgttaattcggataatccctaccctatttcttatttatatagctttatattaactaactttttctaattttaattcttttaatccttgattaagtatatttatactagcattttcatctctatcatgtttcgtatgacattgtagacattcccaaaatcttatatttaaatttttagtatcctcatttttatatccacaaacattacacaattgactagatgggtgaaatctgtctactttatgatatattctattattccattctgatttataagttaattgtcttgttagttcataccatccacaatcatgtattgattttgctaaattatgatttttaaccatacctttaatattaagattttcagaaaatataagttggttttccttaactattttatgagaaatcttatgtaaattatcttttctaatattagctattttttcatgtaatctagcaatttttattctttgttttctccaattattactacctattttctttttagcaatttgcctttgtaattttgctaacttttgttcatatttataacttaattttttattatctattttagtaccatttgatgtaattaataaatctttaatgcctaaatccatagctattttattattattttgctttaattcttgatgttcacattctatattaagactaacaaaatatttattactaggagttttagatactgtagcaaataatattctaccttgaaattctttatgaagttttgctttaatccatttcaatttaggtaattgaattttattattctcaaaatctacttttatattattatttgtaaaatttgtagtataagaataatagtgatttttctttgatttaaatttaggaaatccagtatgctccttaaagaatttctgataagcactatctaaattataaatagaattagttaaagcgaatttatctacttctttaagccaaggatattctttttttaattctctattacaataattattacaaattgttttacttatagatttgctttcatttttatataaatctattttctttgctagtatttgattatatacaaatctaacacatccaaatgttttatttaattgtatttcctgttctttagttggatatatacgatatttaaatcctttgattattattttcataaataaatccaccaccctcctatttttgtttttgactttgaatatatctcttatttgttcttctgtattttctgatacagtagcaataaaataactaggattccataagtgacctccccacagtttcttttttaattcatcaccatattctttcattaataatctagcactaacaccctttaatgctctcataagatttggaatataatgttggggactacactatattagtaggtgtatatggtctaaattactattaacttctaatattttaaagtcattatcttgtgctattttatttaatatttccattaatttattttctatttcaaaatttgtcatacaagcaaaccttcttcgcttaattaaacattgaattctgcttctctagcctcaataaattcattttcccaaaactcatctttttgtttttctaatttattatctaatacaacatctacagacccatcaattaaattaaaatagttgatataggtattatctctagtgtctctaatccaatccattgtaattatacatttgttattctcttgtaaagaaaaatctaataacgaataatacactttgaatccttctttagtttctaattctactgtctttttacttagatcatcaataatttctaataataaatttttctctttcttctgttcatccaaatctattatagctatattaaaaaaatcatctttttttataggtaaaataaaatctataagttcatttaatactttgttttgcatttttcctataagagaaagatctatatctatttcatttattgtagtatagatacatttctttttcctgctttttttaggtttggcacctttcaatataggaatataaacatccctaaatatagtatctttttgatcaccttctaatactttaatatcggtaactatatacttattaccattaatattacttcttgaatttattttatctatttgacatttaatatttgatcctaattgaatatttagttctgcaacataattagataagattatttttccttcttttatcatattgatcacatacctttcaaatctatttattacatatactagtttttttgaaatttttcacaataaaaaagtacgatttttttaaaacaaaataataaataaatataaataaatattatggcttttaaaagctaaaataaagggaggattttataatgaatatgacttcattagtaggcagaattgccactgatttcgaggtgaaacaagtaaataatacatcagttactaattttaaattagcagttaatactagcagaaagaataaagaaggaaatggatacgaaactgcatttcttaccattgttgcatttggtaaaaacgctgaaaatacttataaatatatgagtaaaggagacacaatttcagttatgggtgaattacgcacccgtatatatgaaaaaaatggaatgaaaataactactacagaaatttcagctaaacatatagaatttattaaaaaggctaaagcaaatcaacaacaatcacaaaatcaaaaccaaaatggttataataatcaacaacaatcacaaaatcaaagtgaatataataatcaacaattagcaaatcgagatggatataatcaatcaataaatcaagctggatataatagtccagaattaataaatcaaggtggatattataatcaacagcaaaatcaaagtggatatcaaccaatgcaaaaccaaggcagttatcagcaaccagtaagtcaaggtaattatcaacaaccacaatatcaaaattttagtgactttaatgataagttgataccgccaatagctgacggagatataccattttaaaattaagaaataaaaaaattaattagtatatataaaaatattgtgtaatacatttaaaattattacacaatattttttgtaaaatttaaggaggagttataaatgaatatcaaagttaatggtggagaattcaaaaaatatataggattggcattaaaatctacagcatccagtgctgtcaatgccaatgatataattaatattagtaccgatactggtaaattaattatattatctggatcaagtgattttacattaaaacaagagttaaagaatgtaatcatttcagaagaaggtaatataaatattagcgttaccatattaaacgctattattaaaaaaatgactaatgaagaaatatcattatttatagatcctaaaaataatgatgttttaaaaataaagcaaggtagaaataattcaaaaattgctcttgcaagagaacatactatatcagatattttgaagtctgatataatatatagtttaaatcttgatgcaaaagtatttaaaagcttaatagacactacttcttatgcagtagcacaagatgaagcaagacctatcctattaggccaatacattgaattagaaaagaatttaatcaaaattactgcactagatggatttcgactagtttctaatagtgcaaaaatagaaaatcaacatgaagatatgatattaattcatgcaaataacctaagaaacctgtcatcattaattgatgatagcacagaagaggttatattaaataaaaataataataaagcaatagtagaagttaaaaataaaaactatgtagctattgctgcttctaatattttttcagaagagtttattgaatataagcagcttataggggacttgtcatcatttcctataaaaataaccgtagatagattacaattattaaatactgtagatagaatttctgtagtttctagttttgttaaagaaggtactcatatcttaatgaaactaaataaagactcactagaaattgatggcaacagctctgttgcatcaatgaaaggtgaagtaaatattaaaaataacaattttgaagaagaatttacaataggatttaatcctaagtacattcttgatgctttaaaaaatataaacacaaaagaaatagatatgtttttcaatagcaatgtatctcctgctattataataaacaagccagaaaaagaagaagatattgaaattaatgcattagttcttccagttaaaactattagttaaaatttcaatataaaaaatccaactatattcagtatagttggattttttattatacttcaggaacagaggtcgtttaatttatatacaaagccttataaagtaaaaacattttatatctatatatttatatatatctatcttttagttagggtttaaaatttgtaccctattgaaaagcaaactgtaccttgtagatagcacatcatctttttgtatctatcctataaagtacagtttcccctttacataaaaacaggagtgtcctttcagttattagataaaaattaaatatctcctctatatatccacaataatccataccttttatgtcaaattatattctttctttgtattttttcatattttcccttattataataatatagtataatttttcttgaaattcatacgaaaaatattttataagaaataataattaattatataaaaatatatggctaataaaagctaaaatttaaactaggaggagaaaataatatgttaagcaaaaaaactaaaaaacttataacatcagcaatattaagtttaacaatatctctatcatttttggggactagcataacagcaaaggcctttgatagcacaaaagctgtttacgaattaaaaaatgctagaacgtatgaatatacttggggttatgatatatctattaacagagatgttgattatgcaagaggtgaaatatatttagggtcaataagttctacagcacatcaattagatacaacaccatttagagctactatgaacggtgaacctctaaagatatttaatagcactaaaaattcattagaagaaaaagaaaaagaactactagctaaggagatggataattcctctaataaaaacaaaacatttggaatttggcaacaagatttagatggaaactttagattatatgtgtatgttattaatgctacttctggttttaacaaaacattaaaaataactaaggaatttatatctggtgatttagattatggattatataataaagatactaaagaattcagtgataaattaaaagaagttttaaattcttcatatgatacatcaaatttattacaaattcataaatatgatattaatccacaagatggaacaagcaaaattccttatggtgaaaaagaaatcatagatgaaactaaaagggttactaaagattgtgcaaatgatatggaaaaagttcaggcaatatacaaatttgttgtgacacatatggagtatgttgaggaccctgcatataggaataagggtgccttgtcagccttaaaatctggtaaaggtgtgtgcgaagattatgcttctctatttatagctatgtgtcgagaagtaaatattcctgctagatatgtacatggacttactggcgctactggtaatcatggttgggcagaattttacttaccttattatggttggattatagccgaacctacagtgtcaagcctcagaactgccaatgaagacactttgcagaaggctatgatgacctttataggcacttatgatactaacaatgattttataccttctcactctgtagcaggttataataataatgaagatagatataccgcattatttgatagaattaaaattactggtcaaaatcgaatagtgactataaaaggtgaacctataaaaagtgtagtgtataatcaacctttctctaactatcaagaaaggatagattcagtaaataaattattagaaattgctaaaaatactgaaaaagaagaagatataaaggaagctagagaactagcacaaactttaattgatagtgaagaaagagaaactatactaaaacaattagattatatcggtaaaagtgacgaattaaaatctcaaataggtgcacttgtagtggacctagaaaatagtgatacaataaatactaataaatttgaggaattaaaagaaatattaaacaatgcacctgaagaaattgtagaagaatttaaaacaccatattctaaaatagctaaaagatatgaaatagaaagccttattaaagaaacagaaggaaatttaacagaagaaaatttagacaaactaagtaatcttcttgacaatgcaaatatagaggataaatataagcttagttatacatctaaatataacaagcttcttaatgactacacaaaaaaagtagaagaacaagaacaaactgaatatgaagctaaattacaagctgctactaaagcagttgaaaaagctgaaaatagcaaaaatcaagctgatcttgataatgctagaggattagctaatagcttaaaaactaccgataaatctaacttaaatactagattagataaagtacaaaaagatattgatgataaaaaaacagaagaagaaaagcaagctgaatatgaagtcaaattacaagctgctactaaagcagttgaaaaagctgaaaatagcaaaaatcaaactgatgttgataatgctagaggattagctaatagcttaaaagagatagataaatcaaatctaaatgctagattggataaagtacaaaaaaatatcgatgataaaaagactgaagaagaaaaacaagctgaatatgaagctaaggttcaaactgccacaaaagcagttgaaaaagccgaaaaaactactatatatgaagattatataagcgctacaagattagtatcagaattgcgggattcagaaattcaaacacaattatgggatagactacgtgaagttaaagttgatataggtagaaaggaagaagctacagaactagtaaaattagttgaagaagataatacagaaacaaattacaatagagctttagaatctataaatagattaagagataatgaacttaagcaagatctactaaatagacttaataacgttaaatctaatatagataacaataatgcaaaaaaagaagaagttaataaattagtagcacaagcagaaaaagacaataaagaagaaacttataataaggctttagctgctgtacaatcactagaagatgatcaacttaagaaagaattattaactagacttaataatgttaaatctataatagataataactctaaaaaagaggatgttactaaactagtagagcaggcagaaaaagataataaagaagaaacttacaataaagccttaactgctgtaaaggtactggaagatagccaagctaaaaaagatttattgaataggcttgataaagttaaggttaatatagataaaataaaaacaaatgaagcaatccgattagttgaatatgctgaaaaatatccttctataagtacttataataatgcaagagatacagttaattctataaatgatagcaatacaaaaacagagttattaaatagattgaaaaatgttgaaatcaaaatagaaaaactagatgaaaaaacaaaaacacatcaatttatagactatgtagataacttagttcaatatgcggaaaaattatgcacagaagacgcttataaaaaggcattagaacaagcacagaaaatagaagatgttgaaagcaaaaaagtttatattaatagattaaatgaagtaaaaaataatatagacataaataaagagacggaaacatctcctattaaaactgaattggataagctagagcatgctataaacagtataaatactgtaaataaaaatgatatgcttgcaataaaagaaaagataaatgatttaaaaaatacaaaagaaagacaggatttaatagataagttaaataatatagaaaacaaatataataaattaattaataatcctaattataataaattaattaaatacaatacttggaataacattgtatataaagaatctaaagataaaacttttgctgttaaatttaataaaaatattaattctaatgacataagtaaaaatttatatttacttgatgttgataataactttgaaaaaatccacactaccattaatataaaaggtgaaactgcttatattactgctgataaattatctccagggaaaaaatatatattagtagtttcagatcaaataaaagatagtagaaataaagatttaaaacaaggtttaaaaacatttatacaaattatagaatagaagtcaaaataaaaggacttaggcatctttacatgtctaagtctttttttaatataatattcttctataatattaataccttattgtattttttaactaagatactacctttctgaaactcccaagcctaaaggcatggggttcttaggtactatataacttctatattatctccgaaagtataatatcactaattattttccctaagacttttactatcaaagattaatatcaatctattaatgatagtataacgcccgtttcaaaacgtttaataatttatatacccatgctgcttaaattatttttagatccttgtagtcttaatatttctttattatgaagttttaaaaacttatcaaaatctttttcacactgactattattaatactttttaaatcactagttacattttttattaaataactagaatataagtctctctgtactttaatttgctttccatcataatcaaaataattccatcgttgactaagtttctttttattatattctttatttaaatgattatattgagatgctttcacttctctagtatttatcttataatacaatccacctttagcttttaatttgttctgcaatatagctaaaaacatacttggtgctttatttgctagtgatttaccaaatctttttttccttttaaacttacctttatcattcttttctgtgcttttactacgtttctgaagtgctttataattcatatcttcaacataaaccgtatcacaattttttagtattttattaatcattatattgtggtcttgttctcttatatcagcttgttttctatataaatctttaagtttattctttgcttttatatatttatttgaataattccactctagtttaataccgcgctttacagtgccatcttcattaaaattattagaattagttgctcttttactcctatccatatatcttaatattttgcgtttttcattttctatgttttgaactctaggtgctaattctaatagtttacaatcataatcagatgtataagcaactgtttttgttcctatgtcaataccacaaacacctaaacctatatcattcttaacctcaccttgtttgttaattttaataggagggatgccttctaggattaattgtaaaatgtatttgtattttctacgaacaaattttcttttaatcctacaaaaacatattttatctcttaaagcatctgtttcatatttattattaatatctaatttaactggtatttctagcccattccatgagaacatattagtttctatattatatctaattccagtaccattagatttaccttctaaagaattcaatggtttgtttacacatttgaaatgaatttcttcacctttaccaaataaactatcatctatagctttataaactctagtagcaattttttgagcagtaaaactatctatattctttttaaaatgtctttgtatttgtttaacatctgcatgaagtgaatactcatttaatctaaattcttttaacatattgtttttaatattaaaatatagcttacaaagtttatttcttttcttatcatctttttcgactttatatatatttgatatattattttgattctttctccatctcttggttttaatcatttccctatatctctttaaggcttgacctaacacagcattatatactttccttcctatttcaaagcgtttatctaaaatattttcttgaaatggttgagtttttaattttaaatttaaaacatatctttgtttaggagctttagccatgaatattcaccttgctttctagtatctagcttttttctaaaatatttttgtatatatgcataatctcatattattgttataatttttttaatctatttttacaataaaaaactttaattatttttcctctatatctaggataaagtaaaaaatatatattagtattttcagatcaaataaaagatattagaaataaagatctaaaataaggtttaaagacatttatacaaattgtagaatagagaatatactaaaaggtagcaagacttatatagtctttgctacctttctattatacttctggaactgtcgctgcttctctcaactctttaagttgtttctggaattgcaatatttcttttattatattttctttatttttagtggtgaagtctagctgatttgctttggatataagttcagccatttctttttcaccagctaatatattgttcttttcagcattttctttatatttagctaatgtttccattacctccatataacttttagttttgtccattctgttcttatattggctattattatctaatctatttgttgctttttcagcctttttatacaggttctttaattcatctagattatttattatatcagaataatttagatatgcatctagcttttctactgcatcccttgcttgtatcgctaaatccatttgtgacactttattagttgtatctagtcgcctttgcaattctatttttatatctgaactttctaatttatctatagctgcttgcgcttcttctattgttttaggatcttttgttgctatagcttttcttattaagctttctatatttcttattttattacgttcttcttgcttactttgattttctttacgatctatatatggctttaaagcatccaatactctttgcaattgagctttttcatttttatatatagttgtatttagatcatgaactgctttttttgcatattcataatcttctttatctaaagttgtctttgcttttttaacagcattataagctttaatataagcatccttttctgcttttatttgtttttccaaatcatctaatctatcagttagatcatctttgtctttaccatctggcaatttagctaccttttctttagctctatctatatcatcttcatttttagtagtctcagccttttccactgcttttgttgcatcttctaaatcttttttatttttgtcttctacattaacatttacttcagaagatgtactattttggtcattcatatttcctgcattatctatagccttaacctttattttatgagcacctggagataaggttacttctccagtgtattttacaaattctccattatctattttataaaacacttcttttatgccgcttagcttgtcactagcagctatggtcattttatcatctttaacatttatattagcaattggtaattctttatcaattctatttaccactacttctttagtagctttatttcctgcttcatcttctaccatgaacttataagttccatttttacttatggtaaaggttgttttatctccatttattactttaccgtcaggcaaagttattgacttaacctttttattatctttagcagatatatttaatataatgtctttattggtccaatctacaggattacctgttactttcaatcgtggttcttgcctgaattcgtaataatctgtatgattattaccaacattatctataactgtaactcttactttataattttctgatgctaaatcaatacttatatgattttttgtgttttgtgcaatttctccggtatattttacaatcccaccatcatccatttgatacaaaatttcttttataccgcttagactgtcataagcatctataatcaatttattaccttttacacttacattagttattggagattcattatctatcttacctactattatttccttagtagttttattaccggccttatcttctactataaacttataagtgccattattttttatagtgaaagttaccttgtcattacttactatttctccatttggtagagtaattgatttaacccctatattatctttagctgttatatttaatacaacattattattagtccattctgttggattacctgatacagctattgtaggtaattctttatctatgttacttatatctatttgtttactagtcttattgcctgcattatcagtaacttctactatataagttccattattagatacagtatatttattacctataattacagtatcattaacttttatttctttaacaccacttaaattatctttagcatctatattaatatctacattgccattagtagagtttgttgtagaagttgctaaatttaatgctggcaattctttatctattttatctactaccacttccttagtagttttattacctgcatcatcttctactataaatttataagtgccatttttagttactgtatagtctgctttatcactacttactgttttaccatctggcaaagttattgacttaactttgttattatccttagcagatgcatttaatataatatctttattggtccaacttgttgtgtttcctgttacttctatcgttggtgattctttatcatcaagttttatatgttcatgtttatctatatatttcactagtgtactagatttcaaatttaaagtaggacgaacgccatcaccaatcctattgaaattaatgtcacggtagttgctggtaccattactgtagacatagaacacatcgaagtcagtgcctgctggaagtgcttgcagggttagagtagttggaactctagtccaatatgtccattcataatccctatccccaaattttgctatccttgaagcattatcatgaaaagcattaaaactactaccaacaggttttgaattacaaacttttagtcctatttcctcaagagatggaataaatattttatcatcagtataatagtcttctttaccattaaaatttgtatttattaaatgtgtttctaatatatttgctttcagatctttacttaacttattataaaactctccatttaagtatgccctcaatgatgaattaccccaatggctactaggaagagatttagtatcaaaaggtcttttttctaatatatctttgctcattacagttacagaaccatctggatagccttcatgattcttagctactactacccaatcaatacctgatatattaaatatatcacctaccattaacttatttacttctactgtatctcccactttaatattatcagctgcaaaagccttattatcttttacaatacttaggctattatcttgcatacctatacttataggcatagctaatattgttcccaatgtggttactcctataagcgcttgtgttatcttcttgtttattacttttttatcatatggcttcatattatatcatacctccgaaatgtttaattaattttttattattacaattaattattatttaatatttaaaaaaccgtacttctttctaattaatttctaaaaaaatattgatatttagtttatatacgaagcctacaaaataaaaacat

SEQ ID NO: 70 - DNA, 3891 bp, Clostridium botulinum
atgccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacctttacaaaccctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacagccagatggtagttatagatcagaagagcttaatctagtaataataggaccctcagctgatattatacagtttgaatgtaaaagctttggacatgatgttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgccgaacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatgtagcaagtacacttaataaagctaaatcaataataggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaatttttttaaagtaattaacagaaaaacatatttgaattttgataaagccgtatttagaataaatatagtacctgatgaaaattacacaataaaggatggatttaatttaaaaggtgcaaatttatcaacaaattttaatggtcagaatacagaaattaatagtaggaattttactagattaaaaaattttacaggattatttgaattttataagctgctatgtgtaagagggataataccttttaaaactaaatcattagatgaaggatacaataaggcattaaatgatttatgtatcaaagttaataattgggacttgttttttagtccttcagaagataattttactaatgatttagataaagtagaagaaattacagctgataccaatatagaagcagcagaagaaaatattagtttagatttaatacaacaatattatttaacttttgattttgataatgaacctgaaaatatttcaatagaaaatctttcaagtgatattataggccaattagagcctatgcctaatatagaaagatttcctaatggaaaaaagtatgagttagataaatatactatgttccattatcttcgtgctcaagaatttgaacatggtgattctagaattatcttaacaaattctgctgaagaagcattattaaagcctaatgttgcttatacatttttttcttcaaaatatgtaaagaagattaataaagccgtagaggcatttatgtttttaaattgggcagaagagttagtatatgactttaccgatgaaactaatgaagtaactactatggataaaattgctgatataactataattgttccatatatagggcctgctttaaatataggtaatatgttatctaaaggagagtttgtagaagctataatatttacgggagttgttgctatgttagaatttataccagagtatgctctccctgtatttggtacttttgcaattgtatcatatattgccaataaggttctaactgttcaaacaataaataatgctttaagtaaaagaaatgaaaaatgggatgaagtctataaatatacagtaacaaattggctagcaaaggttaatacacagattgatctaataagggaaaaaatgaaaaaagctttagaaaatcaggcagaagcaacaaaggctataataaactatcagtataatcaatatactgaggaagagaaaaataatattaattttaatattgatgatttaagttcgaaacttaatgagtctataaatagcgctatgattaacataaataaatttttggatcaatgctctgtttcatatttaatgaattctatgataccttatgctgttaaacggttaaaagattttgatgctagtgttagagatgtattattaaagtatatatatgataatagaggaactttagttcttcaagtagatagattaaaagatgaagttaataatacacttagtgcagatataccttttcagctttccaaatacgtagataataaaaaattattatctacatttactgaatatattaagaatattgttaatacctctatattgagtatagtatataaaaaagatgatttaatagatttatctaggtatggagcaaaaataaatattggcgatagagtatattatgattcaatagataaaaatcaaattaaattaattaatttagaaagtagtacaattgaggtaattttaaaaaatgctattgtatataatagtatgtatgaaaattttagtactagcttttggataaaaattcctaagtattttagcaagataaatctaaataatgaatatacaataataaattgtatagaaaataattcaggatggaaagtatcacttaattatggtgaaataatctggactttgcaggataataagcaaaacatacaaagagtagtttttaaatacagtcaaatggttaatatatcagattatataaacagatggatttttgtaactatcactaataatagactaactaaatctaaaatttatataaatggaagattaatagatcaaaaaccaatttcaaatttaggtaatattcatgctagtaataagataatgtttaaattagatggctgtagagatccacgtagatacatcatgataaaatatttcaatcttttcgataaagaattaaatgaaaaagaaatcaaagatttatatgatagtcaatcaaattcaggtattttaaaagacttttggggtaattatttacaatatgataaaccatactatatgttaaatttatttgatccaaataaatatgtcgatgtaaataatataggtattagaggttatatgtatcttaaagggcctagaggtagcgtagtgactacaaacatttatttaaattcaactttgtatgaggggacaaaatttattataaaaaaatatgcttctggaaatgaagataatattgttagaaataatgatcgtgtatatattaatgtagtagttaaaaataaagaatataggttagctactaatgcatcacaggcaggcgtagaaaaaatactaagtgcattagaaatacctgatgtaggaaatctaagtcaagtagtagtaatgaagtcaaaagatgatcaaggaataagaaataaatgcaaaatgaatttacaagataataatgggaatgatataggctttataggatttcatttgtatgataatatagctaaactagtagcaagtaattggtataatagacaagtgggaaaagctagtaggactttcggttgttcatgggagtttattcctgtagatgatggatggggagaaagttcactgtaa

SEQ ID NO: 71 - DNA, 3837 bp, Clostridium botulinum
atgccagttgtaataaatagttttaattatgatgaccctgttaatgatgatacaattttatacatgcagataccatatgaagaaaaaagtaaaaaatattataaagcttttgagattatgcgtaatgtttggataatgcctgagagaaatacaataggaacgaatcctagtgattttgatccaccggcttcattaaagaacggaagcagtgcttattatgatcctaattatttaaccactgatgctgaaaaagatagatatttaaaaacaacgataaaattatttaagagaattaatagtaatcctgcaggggaagttttgttacaagaaatatcatatgctaaaccatatttaggaaatgaccacacgccaattaatgaattccatccagttactagaactacaagtgttaatataaaatcatcaactaatgttgaaagttcaataatattgaatcttcttgtattgggagcaggacctaatatatttgaaaattcttcttaccccgttagaaaactaatgaattcaggtgaagtttatgatccaagtaatgatggttttggatcaattaatatcgtgacattttcacctgagtatgaatatacttttaatgatattagtggagggcataatagtagtacagaatcatttattgcagatcctgcaatttcactagcccatgaattgatacatgcactgcatggattatacggggctaggggagttacttataaagagactataaaagtaaagcaagcacctcttatgatagccgaaaaacccataaggctagaagaatttttaacctttggaggtcaggatttaaatattattactagtgctatgaaggaaaaaatatataacgatcttttagctaactatgaaaaaatagctactagacttagtgaagttaatagtgctcctcctgaatatgatattaatgaatataaaaattattttcaatggaagtatgggttagataaaaatgctgatggaagttatactgtaaatgaaaataaatttaatgaaatttataaaaaattatatagctttacagagattgacttagcaaataaatttaaagtaaaatgtagaaatacttattttattaaatatggatttttaaaagttccaaatttgttagatgatgatatttatactgtatcagaggggtttaatataggtaatttagcagtaaacaatcgcggacaaaatataaatttaaatcctaaaattattgattccattccagataaaggtctagtggaaaagattgttaaactttgtaagagcattattcctagaaaaggtacaaaggcgccaccgcgactatgcattagagtaaataatagggagttattttttgtagcttcagaaagtagctataatgaaaatgatattaatacccctaaagaaattgacgatacaacaaatctaaataataattatagaaataatttagatgaagttattttagattataatagtgagacaatacctcaaatatcaagtcaaacattaaatacacttgtacaagacgatagttatgtgccaagatatgattctaatggaacaagtgaaatagaggaacataatgttgttgaccttaatgcatttttctatttacatgcacaaaaagtaccagaaggtgaaactaatataagtttaacttcttcaattgatacagcattatcagaagaatcgaaagtatatacatttttttcttcagagtttatcaataatatcaataaacctgtacatgcagcattatttataggttggataagccaagtaataagagattttaccactgaatctacacaaaaaagtactgttgataagattgcagacatatctttaattgtaccatatgtaggtcttgctttaaatataggtaatgatgcaagaaaaggaaattttaaggaggcatttgaattattaggagcggctattttattagaagttgtgccagagcttttaattcctgtaattttagtgtttacgataaaatcctttatagattcatctaagaatgaagataaaatcattaaagcaataaataattcattaatcgaaagagaagcaaagtggaaagaagtatatagttggatagtatcaaattggcttactagaattaatacgcaatttaataaaagaaaagaacaaatgtatcaggctttacaaaatcaagtagatgcaataaaaacagtaatagaatataaatataatagttatacttcagatgagaaaaataggcttgaatctgaatataatattaacaatatagaagaagaattgaataaaaaagtttctttagcaatgaaaaatatagaaagatttatagcagaaagttctatatcttatttaatgaagttaataaatgaagccaaagttagtgaattaagagaatatgatgaaggtgttaaggaatatttattagactatattttaaaaaatggatcaatcttaggagatcatgtacaagaattaaatgatttggtgactagtactttgaatagtagtattccatttgaactttcttcatatactaatgataaaattctaattatatattttaataaattatataaaaaaattaaagataattgtattttagatatgcgatatgaaaataataaatttatagatatctctggatatggttcaaatataagcattaatggagaattatatatttatacaacaaatagaaatcaatttacaatatatagtggtaagcttagtgaagttaatatagctcaaaataatgatattatatacaatagcagatatcaaaactttagtattagtttctgggtaaggattcctagatactccaatatagtgaatcttaataatgaatatactataataaattgtatggggaataataattcaggatggaaaatatcacttaattataataaaataatttggactttacaagatactgccggaaataatgaaaaattagtttttaattatacacaaatgattagtatatctgattatataaataaatggatttttgtaactattactaataatagattaggtaattctagaatttacatcaatggaaatttaatagatcaaaaatcaatttcgaatttaggtgatattcatgttagtgataatatattatttaaaattgttggttgtaatgatacaagatatgttggtataagatattttaaagtttttgatacggaattagataaaacagaaattgagactttatatagtgatgagccagatccaagtatcttaaaagacttttggggaaattatttgttatataataaaagatattatttattgaatttactaagaaaagataagtctattactcagagttcaacctttctaagcattagtcgaccaagaggtgttgatcggaaagcaaatattttttcgaacaaaagattatataaaggagtggaagttattataagaaaaaatgagcctatagatatatctaatacagataattttgttagaaaaggcgatctggcatacattaatgtagtagatcgtgatgtagaatatcggctatatgctgatacatcaaatgcacaaccagagaaaacaataaaattaataagaacatctaatccagacgatagcttaggtcaaattatagttatggattcaataggaaataattgcacaatgaattttcaaaacaataatgggggcaatataggattactaggttttcattcaaatactttggttgctagtagttggtattataacaatatacgaagaaatactagcagtaatggatgcttttggagttttatttctaaagagcatggatggcaagaaaactaa

We claim:

1. A method of conjugatively transferring a gene of interest into a recipient *Clostridium* strain, the method comprising
   (a) conjugatively transferring a plasmid comprising
      (i) a native plasmid of a donor *C. botulinum* strain capable of being conjugatively transferred into a recipient *Clostridium* strain, wherein the plasmid comprises a selective marker and wherein the plasmid is selected from the group consisting of pCLJ (SEQ ID NO: 2), pCLL (SEQ ID NO: 3), pBot81E-1133, and pCLD (SEQ ID NO:4); and
      (ii) a nucleotide sequence of a gene of interest capable of being expressed in the recipient *Clostridium* strain, wherein the gene is not native to the donor *C. botulinum* strain,
   wherein the gene of interest is incorporated into the plasmid of the donor *C. botulinum* strain by being operably joined to a promoter effective in *Clostridium* strain, and
   wherein the gene of interest is expressed in the recipient *Clostridium* strains.

2. The method of claim 1, wherein the donor *C. botulinum* strain is selected from *C. botulinum* serotypes A, B, C, D, E, F or G.

3. The method of claim 1, wherein the donor *C. botulinum* strain is selected from *C. botulinum* strains Ba, Ab, Bf, Af or A(B).

4. The method of claim 1, wherein the gene of interest is a gene for expressing clostridial toxins, toxin fragments, or antigenic portions thereof.

5. The method of claim 1, wherein the promoter is a NTNH promoter.

6. The method of claim 1, wherein the donor *Clostridium* strain and the recipient *Clostridium* strain are the same species.

7. A method of conjugatively transferring a gene of interest into a recipient *Clostridium* strain, the method comprising conjugatively transferring a plasmid comprising
   (i) a native plasmid of a donor *C. botulinum* strain capable of being conjugatively transferred into a recipient *Clostridium* strain, wherein the plasmid comprises a selective marker and wherein the plasmid is selected from the group consisting of pBotCDC-A3 (SEQ ID NO: 1), pCLJ (SEQ ID NO: 2), pCLL (SEQ ID NO: 3), pBot81E-1133, and pCLD (SEQ ID NO:4), and
   (ii) a nucleotide sequence of a gene of interest capable of being expressed in the recipient *Clostridium* strain, wherein the gene is not native to the donor *C. botulinum* strain,
   wherein the gene of interest is incorporated into the plasmid of the donor *C. botulinum* strain by being operably joined to a promoter effective in *Clostridium* strains, wherein the gene of interest is expressed in the recipient *Clostridium* strain, and wherein the donor *Clostridium* strain and the recipient *Clostridium* strain are different species.

8. A method of conjugatively transferring a gene of interest into a recipient *Clostridium* strain, the method comprising conjugatively transferring a plasmid comprising
   (i) a native plasmid of a donor *C. botulinum* strain capable of being conjugatively transferred into a recipient *Clostridium* strain, wherein the plasmid comprises a selective marker and wherein the plasmid is selected from the group consisting of pBotCDC-A3 (SEQ ID NO: 1), pCLJ (SEQ ID NO: 2), pCLL (SEQ ID NO: 3), pBot81E-1133, and pCLD (SEQ ID NO:4), and
   (ii) a nucleotide sequence of a gene of interest capable of being expressed in the recipient *Clostridium* strain, wherein the gene is not native to the donor *C. botulinum* strain,
   wherein the gene of interest is incorporated into the plasmid of the donor *C. botulinum* strain by being operably joined to a promoter effective in *Clostridium* strains, wherein the gene of interest is expressed in the recipient *Clostridium* strain, and wherein the recipient *Clostridium* strain is toxic.

9. A method of conjugatively transferring a gene of interest into a recipient *Clostridium* strain, the method comprising conjugatively transferring a plasmid comprising
   (i) a native plasmid of a donor *C. botulinum* strain capable of being conjugatively transferred into a recipient

*Clostridium* strain, wherein the plasmid comprises a selective marker and wherein the plasmid is selected from the group consisting of pBotCDC-A3 (SEQ ID NO: 1), pCLJ (SEQ ID NO: 2), pCLL (SEQ ID NO: 3), pBot81E-1133, and pCLD (SEQ ID NO:4), and (ii) a nucleotide sequence of a gene of interest capable of being expressed in the recipient *Clostridium* strain, wherein the gene is not native to the donor *C. botulinum* strain, wherein the gene of interest is incorporated into the plasmid of the donor *C. botulinum* strain by being operably joined to a promoter effective in *Clostridium* strains, wherein the gene of interest is expressed in the recipient *Clostridium* strain, and wherein the recipient *Clostridium* strain is proteolytic.

10. The method of claim 1 wherein the recipient *Clostridium* strain is LNT01 or Hall A-Hyper.

11. The method of claim 1 wherein the plasmid that is conjugative transferred is larger than 150 kb.

12. The method of claim 1 wherein the conjugative transfer plasmid is further genetically tagged with an antibiotic resistance gene for conferring resistance to erythromycin, tetracycline, chloramphenicol or thiamphenicol.

13. The method of claim 1 wherein the recipient *Clostridium* strain is nontoxic.

14. The method of claim 1 wherein the recipient *Clostridium* strain is nonproteolytic.

\* \* \* \* \*